United States Patent 7,745,391 (HUMAN THROMBOSPONDIN POLYPEPTIDE) - sequence listing, part 277

SEQ ID NO: 840641 - protein, 736 aa, Homo sapiens
MKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGQDKYSSTRKSHGDLLPAPLKPRPPPCQPRPASDGVFLSNSFQPPSAKANSTAHKKGQPLPPPKKSSSYHPSHCKGPNSYPGSTGAAVGAHDACRDAKEKRSKSQDADSPGSSGAPENLTFKERQRLFSQGQDVSNKVKASRKLTELENELNTK

SEQ ID NO: 840642 - protein, 1883 aa, Homo sapiens [sequence omitted]

SEQ ID NO: 840643 - protein, 281 aa, Homo sapiens
MRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGQDKYSSTRKSHGDLLPAPLKPRPPPCQPRPASDGVFLSNSFQPPSAKANSTAHKKGQPLPPPKKSSSYHPSHCKGPNSYPGSTGAAVGAHDACRDAKEKRSKSQDADSPGSSGAPENLTFKERQRLFSQGQDVSNKVKASRKLTELENELNTK

SEQ ID NO: 840644 - protein, 1883 aa, Homo sapiens [sequence omitted]

SEQ ID NO: 840645 - protein, 1637 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKVMVL

SEQ ID NO: 840646 - protein, 674 aa, Homo sapiens; identical to SEQ ID NO: 840636

SEQ ID NO: 840647 - protein, 511 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPG

SEQ ID NO: 840648 - protein, 137 aa, Homo sapiens
MPQAGWKKARDCPIDVGRGRLDSVMLTVFSAGPCGSPQRPWVPSHSRSPMCVYIYYIYMYLLTLESPQGGLVSAWTVSVHSVSFLSSIKEIQKQAVTPGVCTLGTRVTPSLRAPDPRSRGQDTVVFTGPGKGALPCV

SEQ ID NO: 840649 - protein, 110 aa, Homo sapiens
HENIVRKRNKSCHKCALCIIWNNRCSDTSQGVLQPVINIYSNIFLLYNTLGHSCLGKLPTHHVGKEHFLPDCNVIAKNQSQNQEIKPPKFFNCSCCFWAMWQVHISIHMV

SEQ ID NO: 840650 - protein, 2063 aa, Homo sapiens
MVLDDLPNLEDIYTSLCSSTMEDSEMDFDSGLEDDDTKSDSILEDSTIFVAFKGNIDDKDFKWKLDAILKNVPNLLHMESSKLKVQKVEPWNSVRVTFNIPREAAERLRILAQSNNQQLRDLGILSVQIEGEGAINLALAQNRSQDVRMNGPMGAGNSVRMEAGFPMASGPGIIRMNNPATVMIPPGGNVSSSMMAPGPNPELQPRTPRPASQSDAMDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPGYPSQPVEQRPLQQMPPQLMQHVAPPPQPPQQQPQPQLPQQQQPPPPSQPQSQQQQQQQQQMMMMLMMQQDPKSVRLPVSQNVHPPRGPLNPDSQRMPMQQSGSVPVMVSLQGPASVPPSPDKQRMPMPVNTPLGSNSRKMVYQESPQNPSSSPLAEMASLPEASGSEAPSVPGGPNNMPSHVVLPQNQLMMTGPKPGPSPLSATQGATPQQPPVNSLPSSHGHHFPNVAAPTQTSRPKTPNRASPRPYYPQTPNNRPPSTEPSEISLSPERLNASIAGLFPPQINIPLPPRPNLNRGFDQQGLNPTTLKAIGQAPSNLTMNPSNFATPQTHKLDSVVVNSGKQSNSGATKRASPSNSRRSSPGSSRKTTPSPGRQNSKAPKLTLASQTNAALLQNVELPRNVLVSPTPLANPPVPGSFPNNSGLNPQNSTVSVAAVGGVVEDNKESLNVPQDSDCQNSQSRKEQVNIELKAVPAQEVKMVVPEDQSKKDGQPSDPNKLPSVEENKNLVSPAMREAPTSLSQLLDNSGAPNVTIKPPGLTDLEVTPPVVSGEDLKKASVIPTLQDLSSSKEPSNSLNLPHSNELCSSLVHPELSEVSSNVAPSIPPVMSRPVSSSSISTPLPPNQITVFVTSNPITTSANTSAALPTHLQSALMSTVVTMPNAGSKVMVSEGQSAAQSNARPQFITPVFINSSSIIQVMKGSQPSTIPAAPLTTNSGLMPPSVAVVGPLHIPQNIKFSSAPVPPNALSSSPAPNIQTGRPLVLSSRATPVQLPSPPCTSSPVVPSHPPVQQVKELNPDEASPQVNTSADQNTLPSSQSTTMVSPLLTNSPGSSGNRRSPVSSSKGKGKVDKIGQILLTKACKKVTGSLEKGEEQYGADGETEGQGLDTTAPGLMGTEQLSTELDSKTPTPPAPTLLKMTSSPVGPGTASAGPSLPGGALPTSVRSIVTTLVPSELISAVPTTKSNHGGIASESLAGGLVEEKVGSHPELLPSIAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 840651 - protein, 2063 aa, Homo sapiens; identical to SEQ ID NO: 840650

SEQ ID NO: 840652 - protein, 1745 aa, Homo sapiens
MKIHRIGKYYVGSLYHDYTKYKSLSSKNIAVLNPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPGYPSQPVEQRPLQQMPPQLMQHVAPPPQPPQQQPQPQLPQQQQPPPPSQPQSQQQQQQQQQMMMMLMMQQDPKSVRLPVSQNVHPPRGPLNPDSQRMPMQQSGSVPVMVSLQGPASVPPSPDKQRMPMPVNTPLGSNSRKMVYQESPQNPSSSPLAEMASLPEASGSEAPSVPGGPNNMPSHVVLPQNQLMMTGPKPGPSPLSATQGATPQQPPVNSLPSSHGHHFPNVAAPTQTSRPKTPNRASPRPYYPQTPNNRPPSTEPSEISLSPERLNASIAGLFPPQINIPLPPRPNLNRGFDQQGLNPTTLKAIGQAPSNLTMNPSNFATPQTHKLDSVVVNSGKQSNSGATKRASPSNSRRSSPGSSRKTTPSPGRQNSKAPKLTLASQTNAALLQNVELPRNVLVSPTPLANPPVPGSFPNNSGLNPQNSTVSVAAVGGVVEDNKESLNVPQDSDCQNSQSRKEQVNIELKAVPAQEVKMVVPEDQSKKDGQPSDPNKLPSVEENKNLVSPAMREAPTSLSQLLDNSGAPNVTIKPPGLTDLEVTPPVVSGEDLKKASVIPTLQDLSSSKEPSNSLNLPHSNELCSSLVHPELSEVSSNVAPSIPPVMSRPVSSSSISTPLPPNQITVFVTSNPITTSANTSAALPTHLQSALMSTVVTMPNAGSKVMVSEGQSAAQSNARPQFITPVFINSSSIIQVMKGSQPSTIPAAPLTTNSGLMPPSVAVVGPLHIPQNIKFSSAPVPPNALSSSPAPNIQTGRPLVLSSRATPVQLPSPPCTSSPVVPSHPPVQQVKELNPDEASPQVNTSADQNTLPSSQSTTMVSPLLTNSPGSSGNRRSPVSSSKGKGKVDKIGQILLTKACKKVTGSLEKGEEQYGADGETEGQGLDTTAPGLMGTEQLSTELDSKTPTPPAPTLLKMTSSPVGPGTASAGPSLPGGALPTSVRSIVTTLVPSELISAVPTTKSNHGGIASESLAGGLVEEKVGSHPELLPSIAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 840653 - protein, 485 aa, Homo sapiens
MSRPVSSSSISTPLPPNQITVFVTSNPITTSANTSAALPTHLQSALMSTVVTMPNAGSKVMVSEGQSAAQSNARPQFITPVFINSSSIIQVMKGSQPSTIPAAPLTTNSGLMPPSVAVVGPLHIPQNIKFSSAPVPPNALSSSPAPNIQTGRPLVLSSRATPVQLPSPPCTSSPVVPSHPPVQQVKELNPDEASPQVNTSADQNTLPSSQSTTMVSPLLTNSPGSSGNRRSPVSSSKGKGKVDKIGQILLTKACKKVTGSLEKGEEQYGADGETEGQGLDTTAPGLMGTEQLSTELDSKTPTPPAPTLLKMTSSPVGPGTASAGPSLPGGALPTSVRSIVTTLVPSELISAVPTTKSNHGGIASESLAGGLVEEKVGSHPELLPSIAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 840654 - protein, 1969 aa, Homo sapiens
MVLDDLPNLEDIYTSLCSSTMEDSEMDFDSGLEDDDTKSDSILEDSTIFVAFKGNIDDKDFKWKLDAILKNVPNLLHMESSKLKVQKVEPWNSVRVTFNIPREAAERLRILAQSNNQQLRDLGILSVQIEGEGAINLALAQNRSQDVRMNGPMGAGNSVRMEAGFPMASGPGIIRMNNPATVMIPPGGNVSSSMMAPGPNPELQPRTPRPASQSDAMDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPGYPSQPVEQRPLQQMPPQLMQHVAPPPQPPQQQPQPQLPQQQQPPPPSQPQSQQQQQQQQQMMMMLMMQQDPKSVRLPVSQNVHPPRGPLNPDSQRMPMQQSGSVPVMVSLQGPASVPPSPDKQRMPMPVNTPLGSNSRKMVYQESPQNPSSSPLAEMASLPEASGSEAPSVPGGPNNMPSHVVLPQNQLMMTGPKPGPSPLSATQGATPQQPPVNSLPSSHGHHFPNVAAPTQTSRPKTPNRASPRPYYPQTPNNRPPSTEPSEISLSPERLNASIAGLFPPQINIPLPPRPNLNRGFDQQGLNPTTLKAIGQAPSNLTMNPSNFATPQTHKLDSVVVNSGKQSNSGATKRASPSNSRRSSPGSSRKTTPSPGRQNSKAPKLTLASQTNAALLQNVELPRNVLVSPTPLANPPVPGSFPNNSGLNPQNSTVSVAAVGGVVEDNKESLNVPQDSDCQNSQSRKEQVNIELKAVPAQEVKMVVPEDQSKKDGQPSDPNKLPSVEENKNLVSPAMREAPTSLSQLLDNSGAPNVTIKPPGLTDLEVTPPVVSGEDLKKASVIPTLQDLSSSKEPSNSLNLPHSNELCSSLVHPELSEVSSNVAPSIPPVMSRPVSSSSISTPLPPNQITVFVTSNPITTSANTSAALPTHLQSALMSTVVTMPNAGSKVMVSEGQSAAQSNARPQFITPVFINSSSIIQVMKGSQPSTIPAAPLTTNSGLMPPSVAVVGPLHIPQNIKFSSAPVPPNALSSSPAPNIQTGRPLVLSSRATPVQLPSPPCTSSPVVPSHPPVQQVKELNPDEASPQVNTSADQNTLPSSQSTTMVSPLLTNSPGSSGNRRSPVSSSKGKGKVDKIGQILLTKACKKVTGSLEKGEEQYGADGETEGQGLDTTAPGLMGTEQLSTELDSKTPTPPAPTLLKMTSSPVGPGTASAGPSLPGGALPTSVRSIVTTLVPSELISAVPTTKSNHGGIASESLAGGLVEEKVGSHPELLPSIVAGRN

SEQ ID NO: 840655 - protein, 125 aa, Homo sapiens
GSGGTAWNQNAKPSLTVRSGDLVDTAAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 840656 - protein, 2063 aa, Homo sapiens; identical to SEQ ID NO: 840650

SEQ ID NO: 840657 - protein, 2063 aa, Homo sapiens; identical to SEQ ID NO: 840650

SEQ ID NO: 840658 - protein, 1847 aa, Homo sapiens
MDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPGYPSQPVEQRPLQQMPPQLMQHVAPPPQPPQQQPQPQLPQQQQPPPPSQPQSQQQQQQQQQMMMMLMMQQDPKSVRLPVSQNVHPPRGPLNPDSQRMPMQQSGSVPVMVSLQGPASVPPSPDKQRMPMPVNTPLGSNSRKMVYQESPQNPSSSPLAEMASLPEASGSEAPSVPGGPNNMPSHVVLPQNQLMMTGPKPGPSPLSATQGATPQQPPVNSLPSSHGHHFPNVAAPTQTSRPKTPNRASPRPYYPQTPNNRPPSTEPSEISLSPERLNASIAGLFPPQINIPLPPRPNLNRGFDQQGLNPTTLKAIGQAPSNLTMNPSNFATPQTHKLDSVVVNSGKQSNSGATKRASPSNSRRSSPGSSRKTTPSPGRQNSKAPKLTLASQTNAALLQNVELPRNVLVSPTPLANPPVPGSFPNNSGLNPQNSTVSVAAVGGVVEDNKESLNVPQDSDCQNSQSRKEQVNIELKAVPAQEVKMVVPEDQSKKDGQPSDPNKLPSVEENKNLVSPAMREAPTSLSQLLDNSGAPNVTIKPPGLTDLEVTPPVVSGEDLKKASVIPTLQDLSSSKEPSNSLNLPHSNELCSSLVHPELSEVSSNVAPSIPPVMSRPVSSSSISTPLPPNQITVFVTSNPITTSANTSAALPTHLQSALMSTVVTMPNAGSKVMVSEGQSAAQSNARPQFITPVFINSSSIIQVMKGSQPSTIPAAPLTTNSGLMPPSVAVVGPLHIPQNIKFSSAPVPPNALSSSPAPNIQTGRPLVLSSRATPVQLPSPPCTSSPVVPSHPPVQQVKELNPDEASPQVNTSADQNTLPSSQSTTMVSPLLTNSPGSSGNRRSPVSSSKGKGKVDKIGQILLTKACKKVTGSLEKGEEQYGADGETEGQGLDTTAPGLMGTEQLSTELDSKTPTPPAPTLLKMTSSPVGPGTASAGPSLPGGALPTSVRSIVTTLVPSELISAVPTTKSNHGGIASESLAGGLVEEKVGSHPELLPSIAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 840659 - protein, 1151 aa, Homo sapiens
SRVSPCAPRKKKNSQQDLNTPDTRPAGLEEADQPPLPGEQGINLDNSGPKLPEFSNRPPGYPSQPVEQRPLQQMPPQLMQHVAPPPQPPQQQPQPQLPQQQQPPPPSQPQSQQQQQQQQQMMMMLMMQQDPKSVRLPVSQNVHPPRGPLNPDSQRMPMQQSGSVPVMVSLQGPASVPPSPDKQRMPMPVNTPLGSNSRKMVYQESPQNPSSSPLAEMASLPEASGSEAPSVPGGPNNMPSHVVLPQNQLMMTGPKPGPSPLSATQGATPQQPPVNSLPSSHGHHFPNVAAPTQTSRPKTPNRASPRPYYPQTPNNRPPSTEPSEISLSPERLNASIAGLFPPQINIPLPPRPNLNRGFDQQGLNPTTLKAIGQAPSNLTMNPSNFATPQTHKLDSVVVNSGKQSNSGATKRASPSNSRRSSPGSSRKTTPSPGRQNSKAPKLTLASQTNAALLQNVELPRNVLVSPTPLANPPVPGSFPNNSGLNPQNSTVSVAAVGGVVEDNKESLNVPQDSDCQNSQSRKEQVNIELKAVPAQEVKMVVPEDQSKKDGQPSDPNKLPSVEENKNLVSPAMREAPTSLSQLLDNSGAPNVTIKPPGLTDLEVTPPVVSGEDLKKASVIPTLQDLSSSKEPSNSLNLPHSNELCSSLVHPELSEVSSNVAPSIPPVMSRPVSSSSISTPLPPNQITVFVTSNPITTSANTSAALPTHLQSALMSTVVTMPNAGSKVMVSEGQSAAQSNARPQFITPVFINSSSIIQVMKGSQPSTIPAAPLTTNSGLMPPSVAVVGPLHIPQNIKFSSAPVPPNALSSSPAPNIQTGRPLVLSSRATPVQLPSPPCTSSPVVPSHPPVQQVKELNPDEASPQVNTSADQNTLPSSQSTTMVSPLLTNSPGSSGNRRSPVSSSKGKGKVDKIGQILLTKACKKVTGSLEKGEEQYGADGETEGQGLDTTAPGLMGTEQLSTELDSKTPTPPAPTLLKMTSSPVGPGTASAGPSLPGGALPTSVRSIVTTLVPSELISAVPTTKSNHGGIASESLAGGLVEEKVGSHPELLPSIAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 840660 - protein, 1070 aa, Homo sapiens
MVLDDLPNLEDIYTSLCSSTMEDSEMDFDSGLEDDDTKSDSILEDSTIFVAFKGNIDDKDFKWKLDAILKNVPNLLHMESSKLKVQKVEPWNSVRVTFNIPREAAERLRILAQSNNQQLRDLGILSVQIEGEGAINLALAQNRSQDVRMNGPMGAGNSVRMEAGFPMASGPGIIRMNNPATVMIPPGGNVSSSMMAPGPNPELQPRTPRPASQSDAMDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 840661 - protein, 437 aa, Homo sapiens
MAGGPPKALPSTGPHSLRDMPHPLAGSSSEEAVGGDSTPSPDLLMARSFGDKDLILPNGGTPAGTSSPASSSSLLNRLQLDDDIDGETRDLFVIVDDPKKHVCTMETYITYRITTKSTRVEFDLPEYSVRRRYQDFDWLRSKLEESQPTHLIPPLPEKFVVKGVVDRFSEEFVETRRKALDKFLKRITDHPVLSFNEHFNIFLTAKDLNAYKKQGIALLTRMGESVKHVTGGYKLRTRPLEFAAIGDYLDTFALKLGTIDRIAQRIIKEEIEYLVELREYGPVYSTWSALEGELAEPLEGVSACIGNCSTALEELTDDMTEDFLPVLREYILYSDSMKSVLKKRDQVQAEYEAKLEAVALRKEDRPKVPADVEKCQDRMECFNADLKADMERWQNNKRQDFRQLLMGMADKNIQYYEKCLMAWESIIPLLQEKQEAK

SEQ ID NO: 840662 - protein, 424 aa, Homo sapiens
MAGGPPKALPSTGPHSLRDMPHPLAGSSSEEAVGGDSTPSPDLLMARSFGDKDLILPNGGTPAGTSSPASSSSLLNRLQLDDDIDGETRDLFVIVDDPKKHVCTMETYITYRITTKSTRVEFDLPEYSVRRRYQDFDWLRSKLEESQPTHLIPPLPEKFVVKGVVDRFSEEFVETRRKALDKFLKRITDHPVLSFNEHFNIFLTAKDLNAYKKQGIALLTRMGESVKHVTGGYKLRTRPLEFAAIGDYLDTFALKLGTIDRIAQRIIKEEIEYLVELREYGPVYSTWSALEGELAEPLEGVSACIGNCSTALEELTDDMTEDFLPVLREYILYSDSMKSVLKKRDQVQAEYEAKLEAVALRKEDRPKVPADVEKCQDRMECFNADLKADMERWQNNKRQDFRQLLMGMADKNIQYYEKSIADLK

SEQ ID NO: 840663 - protein, 142 aa, Homo sapiens
MPECGSTFQRTSPAPFTVWLLGLWIPAVSEQELKGQPHHGGSALEAVTTSPTDATIFQEHRGREPTTAQWPRTVTLGLKEPTDVVFFGDILHATPDFKLFWRSRQSGNSRFGFSEGNKEQLPPSEGHGGCPVLPELPTRLSS

SEQ ID NO: 840664 - protein, 31 aa, Homo sapiens
MCTLKMFPKNATKGPLLCAVKTLPKYVAKGP

SEQ ID NO: 840665 - protein, 475 aa, Homo sapiens
MSATSVDTQRTKGQDNKVQNGSLHQKDTVHDNDFEPYLTGQSNQSNSYPSMSDPYLSSYYPPSIGFPYSLNEAPWSTAGDPPIPYLTTYGQLSNGDHHFMHDAVFGQPGGLGNNIYQHRFNFFPENPAFSAWGTSGSQGQQTQSSAYGSSYTYPPSSLGGTVVDGQPGFHSDTLSKAPPPIKHNMDIGTWDNKGPVPKAPVPQQAPSPQAAPQPQQVAQPLPAQPPALAQPQYQSPQQPPQTRWVAPRNRNAAFGQSGGAGSDSNSPGNVQPNSAPSVESHPVLEKLKAAHSYNPKEFEWNLKSGRVFIIKSYSEDDIHRSIKYSIWCSTEHGNKRLDSAFRCMSSKGPVYLLFSVNGSGHFCGVAEMKSPVDYGTSAGVWSQDKWKGKFDVQWIFVKDVPNNQLRHIRLENNDNKPVTNSRDTQEVPLEKAKQVLKIISSYKHTTSIFDDFAHYEKRQEEEEVVRKERQSRNKQ

SEQ ID NO: 840666 - protein, 559 aa, Homo sapiens
MSATSVDTQRTKGQDNKVQNGSLHQKDTVHDNDFEPYLTGQSNQSNSYPSMSDPYLSSYYPPSIGFPYSLNEAPWSTAGDPPIPYLTTYGQLSNGDHHFMHDAVFGQPGGLGNNIYQHRFNFFPENPAFSAWGTSGSQGQQTQSSAYGSSYTYPPSSLGGTVVDGQPGFHSDTLSKAPGMNSLEQGMVGLKIGDVSSSAVKTVGSVVSSVALTGVLSGNGGTNVNMPVSKPTSWAAIASKPAKPQPKMKTKSGPVMGGGLPPPPIKHNMDIGTWDNKGPVPKAPVPQQAPSPQAAPQPQQVAQPLPAQPPALAQPQYQSPQQPPQTRWVAPRNRNAAFGQSGGAGSDSNSPGNVQPNSAPSVESHPVLEKLKAAHSYNPKEFEWNLKSGRVFIIKSYSEDDIHRSIKYSIWCSTEHGNKRLDSAFRCMSSKGPVYLLFSVNGSGHFCGVAEMKSPVDYGTSAGVWSQDKWKGKFDVQWIFVKDVPNNQLRHIRLENNDNKPVTNSRDTQEVPLEKAKQVLKIISSYKHTTSIFDDFAHYEKRQEEEEVVRKERQSRNKQ

SEQ ID NO: 840667 - protein, 106 aa, Homo sapiens
RSVAARRGAPGLPRVHADAAQSRPLPPPSPLLSPPPPPLESTPPQCVRVPGSPPLPPRQGPARPAAAAAARPAPGELAAGPGAARARVTGPASRGGPSRRAPRPRV

SEQ ID NO: 840668 - protein, 559 aa, Homo sapiens; identical to SEQ ID NO: 840666

SEQ ID NO: 840669 - protein, 559 aa, Homo sapiens; identical to SEQ ID NO: 840666

SEQ ID NO: 840670 - protein, 185 aa, Homo sapiens
MSATSVDTQRTKGQDNKVQNGSLHQKDTVHDNDFEPYLTGQSNQSNSYPSMSDPYLSSYYPPSIGFPYSLNEAPWSTAGDPPIPYLTTYGQLSNGDHHFMHDAVFGQPGGLGNNIYQHRFNFFPENPAFSAWGTSGSQGQQTQSSAYGSSYTYPPSSLGGTVVDGQPGFHSDTLSKAPGMNSAGE

SEQ ID NO: 840671 - protein, 559 aa, Homo sapiens; identical to SEQ ID NO: 840666

SEQ ID NO: 840672 - protein, 474 aa, Homo sapiens
KTKSGPVMGGGLPPPPIKHNMDIGILGNNIYQHRFNFFPENPAFSAWGTSGSQGQQTQSSAYGSSYTYPPSSLGGTVVDGQPGFHSDTLSKAPGMNSLEQGMVGLKIGDVSSSAVKTVGSVVSSVALTGVLSGNGGTNVNMPVSKPTSWAAIASKPAKPQPKMKTKSGPVMGGGLPPPPIKHNMDIGTWDNKGPVPKAPVPQQAPSPQAAPQPQQVAQPLPAQPPALAQPQYQSPQQPPQTRWVAPRNRNAAFGQSGGAGSDSNSPGNVQPNSAPSVESHPVLEKLKAAHSYNPKEFEWNLKSGRVFIIKSYSEDDIHRSIKYSIWCSTEHGNKRLDSAFRCMSSKGPVYLLFSVNGSGHFCGVAEMKSPVDYGTSAGVWSQDKWKGKFDVQWIFVKDVPNNQLRHIRLENNDNKPVTNSRDTQEVPLEKAKQVLKIISSYKHTTSIFDDFAHYEKRQEEEEVVRKERQSRNKQ

SEQ ID NO: 840673 - protein, 106 aa, Homo sapiens; identical to SEQ ID NO: 840667

SEQ ID NO: 840674 - protein, 559 aa, Homo sapiens; identical to SEQ ID NO: 840666

SEQ ID NO: 840675 - protein, 559 aa, Homo sapiens; identical to SEQ ID NO: 840666

SEQ ID NO: 840676 - protein, 104 aa, Homo sapiens
MWHCGRSFGSRPHTLPRLWASAQAGLSQGCPTHFPTWHTHWDLPGRNAESPLPRSLLQPLGTSDSSSSISFHAPLPHISVDTIPCHWARGMRKLLSARWSPQAM

SEQ ID NO: 840677 - protein, 898 aa, Homo sapiens
MVWALRCHPALLDLRCKVSIHLGLPQILQMSPMQYLGSSTGHRQLFQEGLTGGKGAFMEHLPFASILLSSMSYYLLASLFADKQEMRPDWVTHPKHHSGGARLPVCSFCLEAHSIAISLITSSLSNKARLCTSFRLLFCFLTQSLALSPRLESSGAISAHGNLCLPGSSNSPVLASWVAGITGARHMPSNFFGFLVEMGFYHIGQAGLKLLHSGDPTTLASQSAGITGMSHPAWPLASVLTFVLLPVPHEAEHEVRSQVSKESSNSVGTEILPSAVCRCHVSRDVPQFSCQPWKPKQELSAFVGLHFPSLIQDWVKPNPRCREKHSHLASSDVNDVIWSRFPGLLIFSVQSHDLVYVDFKISLLENLKAAEVIQLLLKNYRLSGLTWWLTPVIPHFGRLRQANPLRLGVRGQPGKHGETPSLLKIQKLAACDGMYLYPQVLRRLRQENHMNLAEGGCSEPRSCHCTPAWVTQRDSVSTKKKKKIYRLSIPNLKIQMLQNLKLAEHQHDTTMENFTHKSTLTLCNAQMYLKYFYKLPLASMFKIYMKHKMNFMLRFGSHLKDSLLIYVNIPKSEKIQTLLILSISDKGYSTYINKVACISQPEKQPKNTLPFPMPMPPLSSDHQYSIDHCVLSFFLSDDSCPNGMGRVSKASQQVSCHLRKQRPPVITVPPFRVSQVCTVMLSALVAAFRLKLRCDPWLNRGLDCDENHHEYKESFEGLLSELSVSGGAQGCMGPGALCLPTHPLCIIFRRVSCILISLNNANMFLFISELLDLPGILFAADRNPSSRFPANSSVKHFAHEPPKLIRAGVVKSPHHRNTGVEGNSGFACLVGIRILDLRRLYEKLAPSNLVVTYSCLSQQAMPFSAFPPSRRWEEAITLRNHQYHHLPFSDEETKASDC

SEQ ID NO: 840678 - protein, 85 aa, Homo sapiens
HLGTSFISDFFFLSEYKKVSAAKQGQKGDHLVNEDSKSHLKNTRVKEANFQLIDRLLTDLFEVVVVLAKRSRGGPWTWNGPRRWI

SEQ ID NO: 840679 - protein, 176 aa, Homo sapiens
MTLAYIPHSALRRRPLPDVCLAPEEKTAPLSRPGHLVGRAEAGALGSARPAAIRGGTRRRATIMPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKNRRNKTSWKKT

SEQ ID NO: 840680 - protein, 113 aa, Homo sapiens
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKNRRNKTSWKKT

SEQ ID NO: 840681 - protein, 176 aa, Homo sapiens; identical to SEQ ID NO: 840679

SEQ ID NO: 840682 - protein, 176 aa, Homo sapiens; identical to SEQ ID NO: 840679

SEQ ID NO: 840683 - protein, 176 aa, Homo sapiens; identical to SEQ ID NO: 840679

SEQ ID NO: 840684 - protein, 176 aa, Homo sapiens; identical to SEQ ID NO: 840679

SEQ ID NO: 840685 - protein, 176 aa, Homo sapiens; identical to SEQ ID NO: 840679

SEQ ID NO: 840686 - protein, 152 aa, Homo sapiens
KRGRTKLGLGTRLGVEEAGALGSARPAAIRGGTRRRATIMPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKNRRNKTSWKKT

SEQ ID NO: 840687 - protein, 149 aa, Homo sapiens
TRLVRGLRVNRHEEAGALGSARPAAIRGGTRRRATIMPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKNRRNKTSWKKT

SEQ ID NO: 840688 - protein, 176 aa, Homo sapiens; identical to SEQ ID NO: 840679

SEQ ID NO: 840689 - protein, 121 aa, Homo sapiens [sequence omitted]

SEQ ID NO: 840690 - protein, 195 aa, Homo sapiens
MTLAYIPHSALRRRPLPDVCLAPEEKTAPLSRPGHLVGRAEAGALGSARPAAIRGGTRRRATIMPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPRPGLGGGPPGAPFKKEGIRRVGRRPDQQLQGEGNN

SEQ ID NO: 840691 - protein, 176 aa, Homo sapiens; identical to SEQ ID NO: 840679

SEQ ID NO: 840692 - protein, 121 aa, Homo sapiens [sequence omitted]

SEQ ID NO: 840693 - protein, 121 aa, Homo sapiens [sequence omitted]

SEQ ID NO: 840694 - protein, 121 aa, Homo sapiens [sequence omitted]

SEQ ID NO: 840695 - protein, 121 aa, Homo sapiens [sequence omitted]

SEQ ID NO: 840696 - protein, 176 aa, Homo sapiens; identical to SEQ ID NO: 840679

SEQ ID NO: 840697 - protein, 236 aa, Homo sapiens
IVQIVQNISSPPSGRRTRKTTEYQLSTLERERYKENQEDSNIVLQVADLTTGELVKDELTESPKYIQKQISYNYSDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 840698 - protein, 171 aa, Homo sapiens
WVDRGLWVDRDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 840699 - protein, 176 aa, Homo sapiens; identical to SEQ ID NO: 840679

SEQ ID NO: 840700 - protein, 176 aa, Homo sapiens; identical to SEQ ID NO: 840679

SEQ ID NO: 840701 - protein, 176 aa, Homo sapiens; identical to SEQ ID NO: 840679

SEQ ID NO: 840702 - protein, 176 aa, Homo sapiens; identical to SEQ ID NO: 840679

SEQ ID NO: 840703 - protein, 176 aa, Homo sapiens; identical to SEQ ID NO: 840679

SEQ ID NO: 840704 - protein, 176 aa, Homo sapiens; identical to SEQ ID NO: 840679

SEQ ID NO: 840705 - protein, 176 aa, Homo sapiens; identical to SEQ ID NO: 840679

SEQ ID NO: 840706 - protein, 176 aa, Homo sapiens; identical to SEQ ID NO: 840679

SEQ ID NO: 840707 - protein, 176 aa, Homo sapiens; identical to SEQ ID NO: 840679

SEQ ID NO: 840708 - protein, 176 aa, Homo sapiens; identical to SEQ ID NO: 840679

SEQ ID NO: 840709 - protein, 176 aa, Homo sapiens; identical to SEQ ID NO: 840679

SEQ ID NO: 840710 - protein, 176 aa, Homo sapiens; identical to SEQ ID NO: 840679

SEQ ID NO: 840711 - protein, 176 aa, Homo sapiens; identical to SEQ ID NO: 840679

SEQ ID NO: 840712 - protein, 126 aa, Homo sapiens
GTVKDELTDLDQSNVTEETPEGEEHHPVADTENKENEVEEVPERRPPRERRFEKPLEEHTGEGGEFSVDRPIIDRPIRGRGGLGKEVEGRAVDVEWAEEMDLILVANVNLIGIVEVIDLLFHITVA

SEQ ID NO: 840713 - protein, 121 aa, Homo sapiens [sequence omitted]

SEQ ID NO: 840714 - protein, 121 aa, Homo sapiens [sequence omitted]

SEQ ID NO: 840715 - protein, 189 aa, Homo sapiens [sequence omitted]

SEQ ID NO: 840716 - protein, 121 aa, Homo sapiens [sequence omitted]

SEQ ID NO: 840717 - protein, 294 aa, Homo sapiens
SSAQLSSAQLSSVSSAQLSSAQLSSAAQLSSAQLSSAQSAQLSSAQLSSAQQLSSAQLSSAQLSQLSSAQLSSAQLSSSAQLSSAQLSSVSSAQLSSAQLSSAAQLSSAQLSSAQSAQLSSAQLSSAQQLSSAQLSSAQLSQLSSAQLSSAQLSSSAQLSSAQLSSVSSAQLSSAQLSSAAQLSSAQLSSAQSAQLSSAQLSSAQQLSSAQLSSAQLSSSAQLSSAQLSSQSVSLSWRSILETLAAQDVAAGEDEVDVGVVGAQTVAAGPTSQVLLLLMWMTQRHSQLWLNWMP

SEQ ID NO: 840718 - protein, 75 aa, Homo sapiens
EAVHPRKGSCPASSLSAGTPRAPPPHCPCLGPRQAPRSHGVTSGAQEPGLSRWSRVSTAKNPVRVAPQGGTGGRI

SEQ ID NO: 840719 - protein, 41 aa, Homo sapiens
MNQTEPWGIPLQTFLQVDSLDQLFPFVPLRGSQSLRDRVRH

SEQ ID NO: 840720 - protein, 99 aa, Homo sapiens
VQGESEVKGQRGGAEEAISHQEQTAGGLRLGWSCVGDGRGLSMGLHLHCPLLPSPWLCPPSGIVGFQQLAPQVLLRLRKAIPVSCLLDSRVAVARSRTR

SEQ ID NO: 840721 - protein, 141 aa, Homo sapiens [sequence omitted]

SEQ ID NO: 840722 - protein, 70 aa, Homo sapiens
INEMSSCWPREIANCHVVERATEKGPKINLSELRGVPGQQPVGNRGKRDLGCVITRNEFYNNLSECGRGL

SEQ ID NO: 840723 - protein, 255 aa, Homo sapiens
MEAEEAQRGASPPISAIEEFSIIPEAPMRSSQVSALGLEAQEDEDPSYKWREEHRLSATQQSELRDVCDYAIETMPSFPKEGSADVEPNQESLVAEACDTPEHWEAVPQSLAGRQARTLAPPELWACPIQSEHLDMAPFSSDLGSEEEEVEFWPGLTSLTLGSGQAEEEEETSSDNSGQTRYYSPCEEHPAETNQNEGSESGTIRQGEELPPEELQESQGLLHPQEVQVLEEQGQQEAGFRGEGTLREDVCADGL

SEQ ID NO: 840724 - protein, 145 aa, Homo sapiens
MDTESSLLLMWFSNLVPACSRSTWLPPNTWSSVSSLAHSLHSPEPLSPCTTQALRAALVLAPGARSWHLSRAPLSTALWNHPPCTSERAPHNYPGMCILQPENQKSGRPADPSPTPHHNPAHHPHEHNVLHSLCTSHTSLHPCTH

SEQ ID NO: 840725 - protein, 109 aa, Homo sapiens
ASQCCQFHLAPLTDHQLAVLHMELKSLSSGFSPLVLVPPLKDTRNSFDFSSPGQAAHYRKLMCAELSLIQAQIPSTIPSPHPTKQGAMVARLEMALLWMGWSGQTSRRR

SEQ ID NO: 840726 - protein, 371 aa, Homo sapiens
KVASWGQRRPRGCRSKRSLCGELANGSFQPCLVGGHWRSAGGSPRQPWGQVRASTLPRALRVASPPLLSVPWCLEGGCGGVPALHGPPPGQPSGLVFHLTLASCTVVKGNHCIMSRYSYQSLLDWLYGGVDPSFAGNGGPDCAAFLSWQQRLLESVVVLTLALLEILVALRHILRQTKEDGRGSPGSQPEQVTQRPEEGKESLSKNLLLVALCLTFGVEVGFKFATKTVIYLLNPCHLVTMMHLPFELEIYYIQHVMLYVVPIYLLWKGGAYTPEPLSSFRWALLSTGLMFFYHFSVLQILGLVTEVNLNNMLCPAISDPFYGPWYRIWASGHQTLMTMTHGKLVILFSYMAGPLCKYLLDLLRLPAKKID

SEQ ID NO: 840727 - protein, 138 aa, Homo sapiens
MMHIFLLACPPCRGAIVVFKLQMHMLNGALLALLFPVVNTRLLPFELEIYYIQHVMLYVVPIYLLWKGGAYTPEPLSSFRWALLSTGLMFFYHFSVLQILGLVTEVNLNNMLCPAISDPFLEDSVDLFLGFTGPVLFP

SEQ ID NO: 840728 - protein, 378 aa, Homo sapiens
KVASWGQRRPRGCRSKRSLCGELANGSFQPCLVGGHWRSAGGSPRQPWGQVRASTLPRALRVASPPLLSVPWCLEGGCGGVPALHGPPPGQPSGLVFHLTLASCTVVKGNHCIMSRYSYQSLLDWLYGGVDPSFAGNGGPDCAAFLSWQQRLLESVVVLTLALLEILVALRHILRQTKEDGRGSPGSQPEQVTQRPEEGKESLSKNLLLVALCLTFGVEVGFKFATKTVIYLLNPCHLVTMMHIFLLACPPCRGAIVVFKLQMHMLNGALLALLFPVVNTRLLPFELEIYYIQHVMLYVVPIYLLWKGGAYTPEPLSSFRWALLSTGLMFFYHFSVLQILGLVTEVNLNNMLCPAISDPFLEDSVDLFLGFTGPVLFP

SEQ ID NO: 840729 - protein, 116 aa, Homo sapiens
MHMLNGALLALLFPVVNTRLLPFELEIYYIQHVMLYVVPIYLLWKGGAYTPEPLSSFRWALLSTGLMFFYHFSVLQILGLVTEVNLNNMLCPAISDPFLEDSVDLFLGFTGPVLFP

SEQ ID NO: 840730 - protein, 137 aa, Homo sapiens [sequence omitted]

SEQ ID NO: 840731 - protein, 138 aa, Homo sapiens; identical to SEQ ID NO: 840727

SEQ ID NO: 840732 - protein, 138 aa, Homo sapiens; identical to SEQ ID NO: 840727

SEQ ID NO: 840733 - protein, 371 aa, Homo sapiens; identical to SEQ ID NO: 840726

SEQ ID NO: 840734 - protein, 139 aa, Homo sapiens
GRQGNRAPGAESAGAEQQPDPGPRAELPQRLLESVVVLTLALLEILVALRHILRQTKEDGRGSPGSQPEQVTQRPEEGKESLSKNLLLVALCLTFGVEVGFKFATKTVIYLLNPCHLVTMMHIFLLACPPCRGAIVVFK

SEQ ID NO: 840735 - protein, 146 aa, Homo sapiens
MCSLQLGPLPKIFLLACPPCRGAIVVFKLQMHMLNGALLALLFPVVNTRLLPFELEIYYIQHVMLYVVPIYLLWKGGAYTPEPLSSFRWALLSTGLMFFYHFSVLQILGLVTEVNLNNMLCPAISDPFLEDSVDLFLGFTGPVLFP

SEQ ID NO: 840736 - protein, 138 aa, Homo sapiens; identical to SEQ ID NO: 840727

SEQ ID NO: 840737 - protein, 138 aa, Homo sapiens; identical to SEQ ID NO: 840727

SEQ ID NO: 840738 - protein, 260 aa, Homo sapiens
KVASWGQRRPRGCRSKRSLCGELANGSFQPCLVGGHWRSAGGSPRQPWGQVRASTLPRALRVASPPLLSVPWCLEGGCGGVPALHGPPPGQPSGLVFHLTLASCTVVKGNHCIMSRYSYQSLLDWLYGGVDPSFAGNGGPDCAAFLSWQQRLLESVVVLTLALLEILVALRHILRQTKEDGRGSPGSQPEQVTQRPEEGKESLSKNLLLVALCLTFGVEVGFKFATKTVIYLLNPCHLVTMMHIFLLACPPCRGAIVVFK

SEQ ID NO: 840739 - protein, 41 aa, Homo sapiens
EYPTVERVDRLAEGACCDSVGPHNEFWFVSVIENAAFALLS

SEQ ID NO: 840740 - protein, 59 aa, Homo sapiens
VFSGGLSLLPEHEVLWVEDANGEWTLHIEAHTCRCRPPGQPLLGNLSSHLATLTAMLMV

SEQ ID NO: 840741 - protein, 111 aa, Homo sapiens
SASQVTGTAGTHPIRWTPPHLVNLFFVDKGFCHVAQAGLKLLGSSNPPNSASQSARIIDRHEPPCPAFTNFLQIISSFHSYCCLPQFRPSKTFTWSIINSLLADVPNDSSS

SEQ ID NO: 840742 - protein, 59 aa, Homo sapiens
SQSAGIIGMSHHTRPGCQFFIRYVFRKYVLPVCGCLFSFPSSGCSLLDEFGPVILQDVP

SEQ ID NO: 840743 - protein, 116 aa, Homo sapiens
MPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERRVSLCHPDWSAVA

SEQ ID NO: 840744 - protein, 3731 aa, Homo sapiens
SCEARESEPGGEGWSLHGGEPEEPPPLPTPPPQPPPPPPRHPPPGADGLVRSRRGGASSGGAGTPPSMVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGEPAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 840745 - protein, 3151 aa, Homo sapiens
MPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGEPAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 840746 - protein, 3712 aa, Homo sapiens
SCEARESEPGGEGWSLHGGEPEEPPPLPTPPPQPPPPPPRHPPPGADGLVRSRRGGASSGGAGTPPSMVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGEPAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 840747 - protein, 3322 aa, Homo sapiens
SCEARESEPGGEGWSLHGGEPEEPPPLPTPPPQPPPPPPRHPPPGADGLVRSRRGGASSGGAGTPPSMVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGEPAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPISLAHLDASP

SEQ ID NO: 840748 - protein, 3731 aa, Homo sapiens; identical to SEQ ID NO: 840744

SEQ ID NO: 840749 - protein, 2529 aa, Homo sapiens
SCEARESEPGGEGWSLHGGEPEEPPPLPTPPPQPPPPPPRHPPPGADGLVRSRRGGASSGGAGTPPSMVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGEPAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSGWASGPACGDFLLEEVILRSQNAAQDKLLANLVFCCCVMNCHTLSSLNQRPFTLS

SEQ ID NO: 840750 - protein, 269 aa, Homo sapiens
MITPSLARGPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 840751 - protein, 202 aa, Homo sapiens
TACLHWAKVQVTNLVQRQCCDTLDVLVCVDTHCRLLTQEGLQTSAETLGSRNISLVFFVHPHLPCSFGCVTLILLLPPSLIHRDVQFTVEEQTERFSLGGICRTWDVCIYKYIIYINIYNTDLKNQIPRHTFFLICAKNVFSEEILFSYSDFVLPTHLYKCASVQHGSCSRDVEVSHGTCTKRLANPSSYYLDLFPQLPNTY

SEQ ID NO: 840752 - protein, 202 aa, Homo sapiens
SCEARESEPGGEGWSLHGGEPEEPPPLPTPPPQPPPPPPRHPPPGADGLVRSRRGGASSGGAGTPPSMVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDG

SEQ ID NO: 840753 - protein, 200 aa, Homo sapiens
PLPIKKVDYPHKRGQNWGSYVHNSLPRFNWDYRSCFHTWKRASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDR

SEQ ID NO: 840754 - protein, 3731 aa, Homo sapiens; identical to SEQ ID NO: 840744

SEQ ID NO: 840755 - protein, 3066 aa, Homo sapiens
MEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGEPAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 840756 - protein, 3595 aa, Homo sapiens
SCEARESEPGGEGWSLHGGEPEEPPPLPTPPPQPPPPPPRHPPPGADGLVRSRRGGASSGGAGTPPSMVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGEPAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVS

SEQ ID NO: 840757 - protein, 3731 aa, Homo sapiens; identical to SEQ ID NO: 840744

SEQ ID NO: 840758 - protein, 166 aa, Homo sapiens
MAYLQKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 840759 - protein, 140 aa, Homo sapiens
HSNIRVAFKVISEVGVFVDLILWVGCGLLFDWRPLLTGSWPLPQVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 840760 - protein, 132 aa, Homo sapiens
AAVRGVVGAAVASGTLETAPPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPISLAHLDASP

SEQ ID NO: 840761 - protein, 206 aa, Homo sapiens
MDEDVLTTLKILIIGESGVGKSSLLLRFTDDTFDPELAATIGVDFKVKTISVDGNKAKLAIWDTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 840762 - protein, 206 aa, Homo sapiens; identical to SEQ ID NO: 840761

SEQ ID NO: 840763 - protein, 206 aa, Homo sapiens; identical to SEQ ID NO: 840761

SEQ ID NO: 840764 - protein, 206 aa, Homo sapiens; identical to SEQ ID NO: 840761

SEQ ID NO: 840765 - protein, 206 aa, Homo sapiens; identical to SEQ ID NO: 840761

SEQ ID NO: 840766 - protein, 319 aa, Homo sapiens
PRLPGSRPLPGPSSLGRSPSCSAEKTPFRGPPLGRQSAVKELDLVTAGKFRFSVRSECFSRGPPLKIKCNCYFSFCHILWRQKISVVLSFFTFSLGKIILTVELSISLLLRFTDDTFDPELAATIGVDFKVKTISVDGNKAKLAIWVTLHQQTANFFLKSQIGNSPILKWAMWQYDTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 840767 - protein, 188 aa, Homo sapiens
MDEDVLTTLKILIIGESGVGKSSLLLRFTDDTFDPELAATIGVDFKVKTISVDGNKAKLAIWDTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVVKLSHREEGQGGGACGGYCSVL

SEQ ID NO: 840768 - protein, 206 aa, Homo sapiens; identical to SEQ ID NO: 840761

SEQ ID NO: 840769 - protein, 206 aa, Homo sapiens; identical to SEQ ID NO: 840761

SEQ ID NO: 840770 - protein, 206 aa, Homo sapiens; identical to SEQ ID NO: 840761

SEQ ID NO: 840771 - protein, 206 aa, Homo sapiens; identical to SEQ ID NO: 840761

SEQ ID NO: 840772 - protein, 206 aa, Homo sapiens; identical to SEQ ID NO: 840761

SEQ ID NO: 840773 - protein, 161 aa, Homo sapiens
MDEDVLTTLKILIIGESGVGKSSLLLRFTDDTFDPELAATIVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 840774 - protein, 759 aa, Homo sapiens
TASVRQVGQLAGAHLATGRGNEGRGRRPGRTRRREPGGAGLGQRARPARLSWKALPLAAAMTSLWREILLESLLGCVSWSLYHDLGPMIYYFPLQTLELTGLEGFSIAFLSPIFLTITPFWKLVNKKWMLTLLRIITIGSIASFQAPNAKLRLMVLALGVSSSLIVQAVTWWSGSHLQRYLRIWGFILGQIVLVVLRIWYTSLNPIWSYQMSNKVILTLSAIATLDRIGTDGDCSKPEEKKTGEVATGMASRPNWLLAGAAFGSLVFLTHWVFGEVSLVSRWAVSGHPHPGPDPNPFGGAVLLCLASGLMLPSCLWFRGTGLIWWVTGTASAAGLLYLHTWAAAVSGCVFAIFTASMWPQTLGHLINSGTNPGKTMTIAMIFYLLEIFFCAWCTAFKFVPGGVYARERSDVLLGTMMLIIGLNMLFGPKKNLDLLLQTKNSSKVLFRKSEKYMKLFLWLLVGVGLLGLGLRHKAYERKLGKVAPTKEVSAAIWPFRFGYDNEGWSSLERSAHLLNETGADFITILESDASKPYMGNNDLTMWLGEKLGFYTDFGPSTRYHTWGIMALSRYPIVKSEHHLLPSPEGEIAPAITLTVNISGKLVDFVVTHFGNHEDDLDRKLQAIAVSKLLKSSSNQVIFLGYITSAPGSRDYLQLTEHGNVKDIDSTDHDRWCEYIMYRGLIRLGYARISHAELSDSEIQMAKFRIPDDPTNYRDNQKVVIDHREVSEKIHFNPRFGSYKEGHNYENNHNFHMNTPKYFL

SEQ ID NO: 840775 - protein, 563 aa, Homo sapiens
TASVRQVGQLAGAHLATGRGNEGRGRRPGRTRRREPGGAGLGQRARPARLSWKALPLAAAMTSLWREILLESLLGCVSWSLYHDLGPMIYYFPLQTLELTGLEGFSIAFLSPIFLTITPFWKLVNKKWMLTLLRIITIGSIASFQAPNAKLRLMVLALGVSSSLIVQAVTWWSGSHLQRYLRIWGFILGQIVLVVLRIWYTSLNPIWSYQMSNKVILTLSAIATLDRIGTDGDCSKPEEKKTGEVATGMASRPNWLLAGAAFGSLVFLTHWVFGEVSLVSRWAVSGHPHPGPDPNPFGGAVLLCLASGLMLPSCLWFRGTGLIWWVTGTASAAGLLYLHTWAAAVSGCVFAIFTASMWPQTLGHLINSGTNPGKTMTIAMIFYLLEIFFCAWCTAFKFVPGGVYARERSDVLLGTMMLIIGLNMLFGPKKNLDLLLQTKNSSKVLFRKSEKYMKLFLWLLVGVGLLGLGLRHKAYERKLGKVAPTKEVSAAIWPFRFGYDNEGWSSLERSAHLLNETGADFITILESDASKPYMGNNDLTMWLGEKLGFYTDFGPSTRYHTWG

SEQ ID NO: 840776 - protein, 48 aa, Homo sapiens
SPHPPEMPPFNCNDVLTHLLIFRDKAHTAFLASKFFITNWHTLAHQSR

SEQ ID NO: 840777 - protein, 80 aa, Homo sapiens
GLMEMYKTTNVGSLPANTTSVLQPMGQRVISTFKSYYLRSAFHKAIAVTDSDSTDGSGQNILKTFQKGFTIQDALGCSGL

SEQ ID NO: 840778 - protein, 80 aa, Homo sapiens; identical to SEQ ID NO: 840777

SEQ ID NO: 840779 - protein, 80 aa, Homo sapiens; identical to SEQ ID NO: 840777

SEQ ID NO: 840780 - protein, 34 aa, Homo sapiens
MVNPQATVNPQATVNPQATVNPQATVNPQATVNP

SEQ ID NO: 840781 - protein, 843 aa, Homo sapiens
ELVWPPRLGATALLAADTGCTMKPALLPWALLLLATALGPGPGPTADAQESCSMRCGALDGPCSCHPTCSGLGTCCLDFRDFCLEILPYSGSMMGGKDFVVRHFKMSSPTDASVICRFKDSIQTLGHVDSSGQVHCVSPLLYESGRIPFTVSLDNGHSFPRAGTWLAVHPNKVSMMEKSELVNETRWQYYGTANTSGNLSLTWHVKSLPTQTITIELWGYEETGMPYSQEWTAKWSYLYPLATHIPNSGSFTFTPKPAPPSYQRWRVGALRIIDSKNYAGQKDVQALWTNDHALAWHLSDDFREDPVAWARTQCQAWEELEDQLPNFLEELPDCPCTLTQARADSGRFFTDYGCDMEQGSVCTYHPGAVHCVRSVQASLRYGSGQQCCYTADGTQLLTADSSGGSTPDRGHDWGAPPFRTPPRVPSMSHWLYDVLSFYYCCLWAPDCPRYMQRRPSNDCRNYRPPRLASAFGDPHFVTFDGTNFTFNGRGEYVLLEAALTDLRVQARAQPGTMSNGTETRGTGLTAVAVQEGNSDVVEVRLANRTGGLEVLLNQEVLSFTEQSWMDLKGMFLSVAAGDRVSIMLASGAGLEVSVQGPFLSVSVLLPEKFLTHTHGLLGTLNNDPTDDFTLHSGRVLPPGTSPQELFLFGANWTVHNASSLLTYDSWFLVHNFLYQPKHDPTFEPLFPSETTLNPSLAQEAAKLCGDDHFCNFDVAATGSLSTGTATRVAHQLHQRRMQSLQPVVSCGWLAPPPNGQKEGNRYLAGSTIYFHCDNGYSLAGAETSTCQADGTWSSPTPKCQPGRSYAVLLGIIFGGLAVVAAVALVYVLLRRRKGNTHVWGAQP

SEQ ID NO: 840782 - protein, 331 aa, Homo sapiens
MSNGTETRGTGLTAVAVQEGNSDVVEVRLANRTGGLEVLLNQEVLSFTEQSWMDLKGMFLSVAAGDRVSIMLASGAGLEVSVQGPFLSVSVLLPEKFLTHTHGLLGTLNNDPTDDFTLHSGRVLPPGTSPQELFLFGANWTVHNASSLLTYDSWFLVHNFLYQPKHDPTFEPLFPSETTLNPSLAQEAAKLCGDDHFCNFDVAATGSLSTGTATRVAHQLHQRRMQSLQPVVSCGWLAPPPNGQKEGNRYLAGSTIYFHCDNGYSLAGAETSTCQADGTWSSPTPKCQPGRSYAVLLGIIFGGLAVVAAVALVYVLLRRRKGNTHVWGAQP

SEQ ID NO: 840783 - protein, 87 aa, Homo sapiens
LPLQVPSPTAPGCRPPCPGAAGGDKMLTAGDPNASPLSPGMFLSVAAGDRVSIMLASGAGLEVSVQGPFLSVSVLLPEKFLTHTHGL

SEQ ID NO: 840784 - protein, 843 aa, Homo sapiens; identical to SEQ ID NO: 840781

SEQ ID NO: 840785 - protein, 676 aa, Homo sapiens
ELVWPPRLGATALLAADTGCTMKPALLPWALLLLATALGPGPGPTADAQESCSMRCGALDGPCSCHPTCSGLGTCCLDFRDFCLEILPYSGSMMGGKDFVVRHFKMSSPTDASVICRFKDSIQTLGHVDSSGQVHCVSPLLYESGRIPFTVSLDNGHSFPRAGTWLAVHPNKVSMMEKSELVNETRWQYYGTANTSGNLSLTWHVKSLPTQTITIELWGYEETGMPYSQEWTAKWSYLYPLATHIPNSGSFTFTPKPAPPSYQRWRVGALRIIDSKNYAGQKDVQALWTNDHALAWHLSDDFREDPVAWARTQCQAWEELEDQLPNFLEELPDCPCTLTQARADSGRFFTDYGCDMEQGSVCTYHPGAVHCVRSVQASLRYGSGQQCCYTADGTQLLTADSSGGSTPDRGHDWGAPPFRTPPRVPSMSHWLYDVLSFYYCCLWAPDCPRYMQRRPSNDCRNYRPPRLASAFGDPHFVTFDGTNFTFNGRGEYVLLEAALTDLRVQARAQPGTMSNGTETRGTGLTAVAVQEGNSDVVEVRLANRTGGLEVLLNQEVLSFTEQSWMDLKGMFLSVAAGDRVSIMLASGAGLEVSVQGPFLSVSVLLPEKFLTHTHGLLGTLNNDPTDDFTLHSGRVLPPGTSPQELFLFGANWTVHMRPPAHLRFLVLPEMGSSRSP

SEQ ID NO: 840786 - protein, 118 aa, Homo sapiens
VAIQSVRCYSHGSQETDEEFDARWVTYFNKPDIDAWELRKGINTLVTYDMVPEPKIIDAALRACRRLNDFASTVRILEVVKDKAGPHKEIYPYVIQELRPTLNELGISTPEELGLDKV

SEQ ID NO: 840787 - protein, 163 aa, Homo sapiens [sequence omitted]

SEQ ID NO: 840788 - protein, 1334 aa, Homo sapiens
HEEESEKKGCRWRGGGLTSACSVGSGGGAQHPSYSALGGGLRENTAIFMCKCCNLFSPNQSELLSHVSEKHMEEGVNVDEIIIPLRPLSTPEPPNSSKTRDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKKRSMLCNLETKSKMCKRMQTEEKARSLHKSTGGFRGRLAGFRDTYFCFQILDVLQPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 840789 - protein, 1323 aa, Homo sapiens
HEEESEKKGCRWRGGGLTSACSVGSGGGAQHPSYSALGGGLRENTAIFMCKCCNLFSPNQSELLSHVSEKHMEEGVNVDEIIIPLRPLSTPEPPNSSKTRDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALVFGGGSCNTMNECLFLQILIYLKRLTPESDLRLLQVIKEAHLAQDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 840790 - protein, 131 aa, Homo sapiens
NLASVSCTGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 840791 - protein, 1154 aa, Homo sapiens
HEEESEKKGCRWRGGGLTSACSVGSGGGAQHPSYSALGGGLRENTAIFMCKCCNLFSPNQSELLSHVSEKHMEEGVNVDEIIIPLRPLSTPEPPNSSKTRDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWEHRGGAQLQPHGHDPGDGPASVRGACRAAPPGGVLRRRGGH

SEQ ID NO: 840792 - protein, 1279 aa, Homo sapiens
HEEESEKKGCRWRGGGLTSACSVGSGGGAQHPSYSALGGGLRENTAIFMCKCCNLFSPNQSELLSHVSEKHMEEGVNVDEIIIPLRPLSTPEPPNSSKTRDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 840793 - protein, 319 aa, Homo sapiens
LILTWQGTPLCTWLHAWHFIHSGSCWPGDAHLVLRFFPGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 840794 - protein, 48 aa, Homo sapiens
MRLFPRAGLGSQPGPECGQPGQISGPCPDRAGTSKPCSLILASACPAH

SEQ ID NO: 840795 - protein, 348 aa, Homo sapiens
MAAGVAGWGVEAEEFEDAPDVEPLEPTLSNIIEQRSLKWIFVGGKGGVGKTTCSCSLAVQLSKGRESVLIISTDPAHNISDAFDQKFSKVPTKVKGYDNLFAMEIDPSLGVAELPDEFFEEDNMLSMGKKMMQEAMSAFPGIDEAMSYAEVMRLVKGMNFSVVVFDTAPTGHTLRLLNFPTIVERGLGRLMQIKNQISPFISQMCNMLGLGDMNADQLASKLEETLPVIRSVSEQFKDPEQTTFICVCIAEFLSLYETERLIQELAKCKIDTHNIIVNQLVFPDPEKPCKMCEARHKIQAKYLDQMEDLYEDFHIVKLPLLPHEVRGADKVNTFSALLLEPYKPPSAQ

SEQ ID NO: 840796 - protein, 322 aa, Homo sapiens
MAAGVAGWGVEAEEFEDAPDVEPLEPTLSNIIEQRSLKWIFVGGKGGVGKTTCSCSLAVQLSKGRESVLIISTDPAHNISDAFDQKFSKVPTKVKGYDNLFAMEIDPSLGVAELPDEFFEEDNMLSMGKKMMQEAMSAFPGIDEAMSYAEVMRLVKGMNFSVVVFDTAPTGHTLRLLNFPTIVERGLGRLMQIKNQISPFISQMCNMLGLGDMNADQLASKLEETLPVIRSVSEQFKDPEQTTFICVCIAEFLSLYETERLIQELAKCKIDTHNIIVNQLVLHPPHPLGAEFAQSPPHNTGGATWAGGREGSIPPGGAGGEL

SEQ ID NO: 840797 - protein, 220 aa, Homo sapiens
MAAGVAGWGVEAEEFEDAPDVEPLEPTLSNIIEQRSLKWIFVGGKGGVGKTTCSCSLAVQLSKGRESVLIISTDPAHNISDAFDQKFSKVPTKVKGYDNLFAMEIDPSLGVAELPDEFFEEDNMLSMGKKMMQEAMSAFPGIDEAMSYAEVMRLVKGMNFSVVVFDTAPTGHTLRLLNFPTIVERGLGRLMQIKNQISPFISQAGGGGPHLHHPGSREWE

SEQ ID NO: 840798 - protein, 128 aa, Homo sapiens
MAAGVAGWGVEAEEFEDAPDVEPLEPTLSNIIEQRSLKWIFVGGKGGVGKTTCSSKEAAAGSSWSPTSPPVPSSTAASPNRCHFTLTLHPPHPLGAEFAQSPPHNTGGATWAGGREGSIPPGGAGGEL

SEQ ID NO: 840799 - protein, 166 aa, Homo sapiens
KGHGLGVWLVAKVLRMVRSAGSREPVPKWRQGWPGGGLRQRSSKMLLMWSRWSLHLVLKGAQETPNIIEQRSLKWIFVGGKGGVGKTTCRQTRSTPSRPSSWSPTSPPVPSSTAASPNRCHFTLTLHPPHPLGAEFAQSPPHNTGGATWAGGREGSIPPGGAGGEL

SEQ ID NO: 840800 - protein, 348 aa, Homo sapiens; identical to SEQ ID NO: 840795

SEQ ID NO: 840801 - protein, 217 aa, Homo sapiens
MAAGVAGWGVEAEEFEDAPDVEPLEPTLSNIIEQRSLKWIFVGGKGGVGKTTCSCSLAVQLSKGRESVLIISTDPAHNISDAFDQKFSKVPTKVKGYDNLFAMEIDPSLGVAELPDEFFEEDNMLSMGKKMMQEAKCKIDTHNIIVNQLVFPDPEKPCKMCEARHKIQAKYLDQMEDLYEDFHIVKLPLLPHEVRGADKVNTFSALLLEPYKPPSAQ

SEQ ID NO: 840802 - protein, 214 aa, Homo sapiens
MAAGVAGWGVEAEEFEDAPDVEPLEPTLSNIIEQRSLKWIFVGGKGGVGKTTCSCSLAVQLSKGRESVLIISTDPAHNISDAFDQKFSKVPTKVKGYDNLFAMEIDPSLGVAELPDEFFEEDNMLSMGKKMMQEAMSAFPGIDEAMSYAEVMRLVKGMNLLRWGVFDSCARARVPLCLLQPHPVGVCASLDPKKPSIHALFHSPPALLTLPVCP

SEQ ID NO: 840803 - protein, 72 aa, Homo sapiens
ERLIQELAKCKIDTHNIIVNQLVFPDPEKPCKMCEARHKIQAKYLDQVCPPTQHWLSRGTSAPLFSDLLLHH

SEQ ID NO: 840804 - protein, 75 aa, Homo sapiens
EQSDSHLEEDTGAESDGAVVPGEEIFYFGILERRDNEDDMEFINMLSLIYTTACPMLLAEQSVLLAYADAIVYKC

SEQ ID NO: 840805 - protein, 147 aa, Homo sapiens [sequence omitted]

SEQ ID NO: 840806 - protein, 147 aa, Homo sapiens [sequence omitted]

SEQ ID NO: 840807 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 840808 - protein, 200 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVG

SEQ ID NO: 840809 - protein, 102 aa, Homo sapiens
KIKSLLEDYLDQKPEPDGNLPGHACGVLDSSRFVNCWTRFAEWGVQAEDKSELHSSRQRRALIEKKAKKRRRYKERVMLSKEFGKEMDMCTGMIMDKPGHVG

SEQ ID NO: 840810 - protein, 109 aa, Homo sapiens
MPCLALAVPTPAGTWGLGAGPRSPAVCLVSGQGWWSPPLGLAPWAQGPASLCPVRRDPLMPSGQPGELLAERPGLRWLAWRLPRCSSLPAWPSGARRPPQTLLCLRVSP

SEQ ID NO: 840811 - protein, 344 aa, Homo sapiens
MAAATEHNRPSSGDRNLERRCSPNLSREVLYEIFRSLHTLVGQLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQRIKKLEDKILELEGISPEYFQSVSFSGKRRKVQPPQQNYSLAELDEKISALKQALLRKSREAESMATHHLP

SEQ ID NO: 840812 - protein, 301 aa, Homo sapiens
MAAATEHNRPSSGDRNLERRCSPNLSREVLYEIFRSLHTLVGQLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQRIKKLEDKILELEGISPEYFQSVACEHT

SEQ ID NO: 840813 - protein, 302 aa, Homo sapiens
MLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQRIKKLEDKILELEGISPEYFQSVSFSGKRRKVQPPQQNYSLAELDEKISALKQALLRKSREAESMATHHLP

SEQ ID NO: 840814 - protein, 351 aa, Homo sapiens
MAAATEHNRPSSGDRNLERRCSPNLSREVLYEIFRSLHTLVGQLDLRDDVVKITIDWNKLQSLSAFQPALLFSALEQHILYLQMELCCSQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQRIKKLEDKILELEGISPEYFQSVSFSGKRRKVQPPQQNYSLAELDEKISALKQALLRKSREAESMATHHLP

SEQ ID NO: 840815 - protein, 189 aa, Homo sapiens
NLRRLEALGLVSARNGYQGLVDELAKDIRNQHRHRHRRKAELVKLQATLQGLSTKTTFYEEQGDYYSQYIRACLDHLAPDSKSSGKGKKQPSLHYTAAQLLEKGVLVEIEDLPASHFRNVIFDITPGDEAGKFEVNAKFLGVDMERFQLHYQDLLQLQYEGVAVMKLFNKAKVNVNLLIFLLNKKFLRK

SEQ ID NO: 840816 - protein, 189 aa, Homo sapiens; identical to SEQ ID NO: 840815

SEQ ID NO: 840817 - protein, 189 aa, Homo sapiens; identical to SEQ ID NO: 840815

SEQ ID NO: 840818 - protein, 38 aa, Homo sapiens
DTQVILQEKYDTASVLENDEAHLKKYRITSYVREYEEK

SEQ ID NO: 840819 - protein, 42 aa, Homo sapiens
MLDPHTAPSAQLRSTSVVHLDYKFLKGQGPVLLHPQLLALSL

SEQ ID NO: 840820 - protein, 126 aa, Homo sapiens
MMSIRQRREIRATEVSEDFPAQEENVKLENKLPSGCTSRRLWKILSLTIGGTIALCIGLLTSVYLATLHENDLWFSNIKEVEREISFRTECGLYYSYYKQMLQAPTLVQGFHGLIYDNKTESMKTI

SEQ ID NO: 840821 - protein, 237 aa, Homo sapiens
RPRSESPEQTGLNADQASGSVPLPSGQRSTRRGGEPREEAGPSVDEQLPGPMGAGAAARPLRRAPSPGLLTPPSPSFPQSSAAVLPSLYPRRAAARGAAPFPPSPVGLLPLPEPRVRTAEGRRSDLENNACKSDIMMSIRQRREIRATEVSEDFPAQEENVKLENKLPSGCTSRRLWKILSLTIGGTIALCIGLLTSVYLATLHENDLWFSNIKVWSFFDHCIIHSVGSPVVSHVDE

SEQ ID NO: 840822 - protein, 88 aa, Homo sapiens
MPRYISLHICYRIPHGMKNTGQSVAEQLQKADAYTVELENAESRVAKLRDEGERLHLPYALLQEVYKLEDVLDSMWGMLRARTTDIGS

SEQ ID NO: 840823 - protein, 163 aa, Homo sapiens
TLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARTTDIGS

SEQ ID NO: 840824 - protein, 293 aa, Homo sapiens [sequence omitted]

SEQ ID NO: 840825 - protein, 207 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKRGTLDFPQLMKMRYLEVSEPQDIDVLWGPRILRQSL

SEQ ID NO: 840826 - protein, 125 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRAKVDAAANLVVVVDPGIP

SEQ ID NO: 840827 - protein, 157 aa, Homo sapiens
QTHLAGGTTYTFSTGEDGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSPRTSTHIHL

SEQ ID NO: 840828 - protein, 293 aa, Homo sapiens [sequence omitted]

SEQ ID NO: 840829 - protein, 293 aa, Homo sapiens [sequence omitted]

SEQ ID NO: 840830 - protein, 293 aa, Homo sapiens [sequence omitted]

SEQ ID NO: 840831 - protein, 293 aa, Homo sapiens [sequence omitted]

SEQ ID NO: 840832 - protein, 293 aa, Homo sapiens [sequence omitted]

SEQ ID NO: 840833 - protein, 235 aa, Homo sapiens
MEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 840834 - protein, 342 aa, Homo sapiens
MSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEVWIWLRVQVSLVQGGGASNLQFIQALLDSEEENDRAWDGRLGERYYPPVDADA

SEQ ID NO: 840835 - protein, 264 aa, Homo sapiens
MSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGGGGRRGRRRGRNLNQ

SEQ ID NO: 840836 - protein, 293 aa, Homo sapiens [sequence omitted]

SEQ ID NO: 840837 - protein, 293 aa, Homo sapiens [sequence omitted]

SEQ ID NO: 840838 - protein, 293 aa, Homo sapiens [sequence omitted]

SEQ ID NO: 840839 - protein, 293 aa, Homo sapiens [sequence omitted]

SEQ ID NO: 840840 - protein, 207 aa, Homo sapiens; identical to SEQ ID NO: 840825

SEQ ID NO: 840841 - protein, 293 aa, Homo sapiens [sequence omitted]

SEQ ID NO: 840842 - protein, 336 aa, Homo sapiens
RVQLRPRTSCARGTVAHHRRACIRKLAKTQGNVFATDAILATLMSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 840843 - protein, 207 aa, Homo sapiens; identical to SEQ ID NO: 840825

SEQ ID NO: 840844 - protein, 256 aa, Homo sapiens
LLSNINILVRFELFNLCTQIDWRATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 840845 - protein, 205 aa, Homo sapiens
ISLPPPCWGQRESDTEVITVEKSSPIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 840846 - protein, 155 aa, Homo sapiens
VSLTELLLQHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 840847 - protein, 158 aa, Homo sapiens
PSSFTSEWYYTQEITGITWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 840848 - protein, 207 aa, Homo sapiens; identical to SEQ ID NO: 840825

SEQ ID NO: 840849 - protein, 86 aa, Homo sapiens
TPVNAITVPGIPLIECLDVDEGHFPVGSSHDAIVLTTDNKVNKYLILKDPNKQVIRVYSLPDGTFSSDEDEEEEEEEEEEEEEEET

SEQ ID NO: 840850 - protein, 118 aa, Homo sapiens
VSLTELLLQHCNGVDWRQKLDSQRGAVIATELKNNSYKLARWTCCALLAGSEYLKLGYVSRYHVKDSSRHVILGTQQFKPNEFASQYNLPGEYNLPVEYPCRWSTTCRWSTPAVEYTS

SEQ ID NO: 840851 - protein, 293 aa, Homo sapiens [sequence omitted]

SEQ ID NO: 840852 - protein, 293 aa, Homo sapiens [sequence omitted]

SEQ ID NO: 840853 - protein, 292 aa, Homo sapiens
MSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEAGD

SEQ ID NO: 840854 - protein, 215 aa, Homo sapiens
MSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSPRTSTHIHL

SEQ ID NO: 840855 - protein, 293 aa, Homo sapiens [sequence omitted]

SEQ ID NO: 840856 - protein, 207 aa, Homo sapiens; identical to SEQ ID NO: 840825

SEQ ID NO: 840857 - protein, 293 aa, Homo sapiens [sequence omitted]

SEQ ID NO: 840858 - protein, 293 aa, Homo sapiens [sequence omitted]

SEQ ID NO: 840859 - protein, 207 aa, Homo sapiens; identical to SEQ ID NO: 840825

SEQ ID NO: 840860 - protein, 208 aa, Homo sapiens
RTRGSTHASGMKSPLLRTVYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 840861 - protein, 299 aa, Homo sapiens
GTQQLKPNEFASQINLSVENAWGILRCVIDICMKLEEGKYLILKDPNKQVIRVYSLPDGTFSSDEDEEEEEEEEEEEEEEELKPVMWSWSLSFHRDSSAKLILGTQQFKPNEFASQINLSVEMPGDYHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 840862 - protein, 236 aa, Homo sapiens
MAKFMTPVIQDNPSGWGPCAVPEQFRDMPYQPFSKGDRLGKTAAALDRDPTLPQNNAGYTHISYLLISSLAGWKPHTSLPYTSPTGTRTALHTRYALSRRPAPGTTTPPPTTTHTHRAPTPRRATPPHTCSTSGPQQRTPLRQDAPHTQLRLRDNTCYDKHLTPMASTSLPPTTQPDTNTHAHTHDARTPPTLQHRGPRNTPHASPTQTQHLSAGASTSTHTTAGTPRTHPTQEQT

SEQ ID NO: 840863 - protein, 58 aa, Homo sapiens
MGTARSPHPTCELLVAGLSPGPIRVWGVSVRCHRVCTGLASSRTLQASCGTGAERDQP

SEQ ID NO: 840864 - protein, 124 aa, Homo sapiens [sequence omitted]

SEQ ID NO: 840865 - protein, 114 aa, Homo sapiens
NHEGETKWMANWPPLKSCCSLCLASLLSFTMAMAVWHREDPLQQPPHRESEREKLFLFLLIYLFIETGFHHVGQAGLELLTSSDPPTSVSQSARITGHEPLRPASIVSFQNSSK

SEQ ID NO: 840866 - protein, 102 aa, Homo sapiens
MKDCSNSRGLGGQFEGLHVNIKVDAINSLDWELASLFILEPVAGLRKKTKKKKKKKRNEPKNPNKLSELIQKTGGRITWAQEFETSLGNKVRSYLYKKYKIL

SEQ ID NO: 840867 - protein, 103 aa, Homo sapiens
EGTAFMSCCPSPLCHVRMLLQEDAFTGTDPQRSCQCFDLGLARLQNCEKKKILLFINYPVCVILLLQYKPGRPTYLCLGGPQKNVAFTAVFAEPAHIHGFIEV

SEQ ID NO: 840868 - protein, 140 aa, Homo sapiens
MIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGNWSTPEVGLCVPGALILL

SEQ ID NO: 840869 - protein, 769 aa, Homo sapiens
YACVHAAGRAGLRGEGAAAAEAASLFPWSGQCVAARVTTGEVGIMVMKASVDDDDSGWELSMPEKMEKSNTNWVDITQDFEEACRELKLGELLHDKLFGLFEAMSAIEMMDPKMDAGMIGNQVNRKVLNFEQAIKDGTIKIKDLTLPELIGIMDTCFCCLITWLEGHSLAQTVFTCLYIHNPDFIEDPAMKAFALGILKICDIAREKVNKAAVFEEEDFQSMTYGFKMANSVTDLRVTGMLKDVEDDMQRRVKSTRSRQGEERDPEVELEHQRCLAVFSRVKFTRVLLTVLIAFTKKETSAVAEAQKLMVQAADLLSAIHNSLHHGIQAQNDTTKGDHPIMMGFEPLVNQRLLPPTFPRYAKIIKREEMVNYFARLIDRIKTVCEVVNLTNLHCILDFFCEFSEQSPCVLSRSLLQTTFLVDNKKVFGTHLMQDMVKDALRSFVSPPVLSPKCYLYNNHQAKDCIDSFVTHCVRPFCSLIQIHGHNRARQRDKLGHILEEFATLQDEAEKVDAALHTMLLKQEPQRQHLAWLGTWVLYHNLRIMIQYLLSGFELELYSMHEYYYIYWYLSEFLYAWLMSTLSRADGSQMAEERIMEEQQKGRSSKKTKKKKKVRPLSREITMSQAYQNMCAGMFKTMVAFDMDGKVRKPKFELDSEQVRYEHRFAPFNSVMTPPPVHYLQFKEMSDLNKYSPPPQSPELYVAASKHFQQAKMILENIPNPDHEVNRILKVAKPNFVVMKLLAGGHKKESKVPPEFDFSAHKYFPVVKLV

SEQ ID NO: 840870 - protein, 241 aa, Homo sapiens
YACVHAAGRAGLRGEGAAAAEAASLFPWSGQCVAARVTTGEVGIMVMKASVDDDDSGWELSMPEKMEKSNTNWVDITQDFEEACRELKLGELLHDKLFGLFEAMSAIEMMDPKMDAGMIGNQVNRKVLNFEQAIKDGTIKIKDLTLPELIGIMDTCFCCLITWLEGHSLAQTVFTCLYIHNPDFIEDPAMKAFALGILKICDIAREKVNKAAVFEEISRLLELIDFHEYNFKNENVQCWKE

SEQ ID NO: 840871 - protein, 769 aa, Homo sapiens; identical to SEQ ID NO: 840869

SEQ ID NO: 840872 - protein, 618 aa, Homo sapiens
YACVHAAGRAGLRGEGAAAAEAASLFPWSGQCVAARVTTGEVGIMVMKASVDDDDSGWELSMPEKMEKSNTNWVDITQDFEEACRELKLGELLHDKLFGLFEAMSAIEMMDPKMDAGMIGNQVNRKVLNFEQAIKDGTIKIKDLTLPELIGIMDTCFCCLITWLEGHSLAQTVFTCLYIHNPDFIEDPAMKAFALGILKICDIAREKVNKAAVFEEEDFQSMTYGFKMANSVTDLRVTGMLKDVEDDMQRRVKSTRSRQGEERDPEVELEHQRCLAVFSRVKFTRVLLTVLIAFTKKETSAVAEAQKLMVQAADLLSAIHNSLHHGIQAQNDTTKGDHPIMMGFEPLVNQRLLPPTFPRYAKIIKREEMVNYFARLIDRIKTVCEVVNLTNLHCILDFFCEFSEQSPCVLSRSLLQTTFLVDNKKVFGTHLMQDMVKDALRSFVSPPVLSPKCYLYNNHQAKDCIDSFVTHCVRPFCSLIQIHGHNRARQRDKLGHILEEFATLQDEAEKVDAALHTMLLKQEPQRQHLAWLGTWVLYHNLRIMIQYLLSGFELELYSMHEYYYIYWYLSEFLYAWLMSTLSRADGSQMAEERIMEEQQKGRSSKKTKKKKKGAVDYF

SEQ ID NO: 840873 - protein, 259 aa, Homo sapiens
PKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVPYCIIKGKARLGRLVHRKTCTTVAFTQVNSEDKGALAKLVEAIRTNYNDRYDEIRRHWGGMSWVLSLWSYRQARKGKVRIA

SEQ ID NO: 840874 - protein, 242 aa, Homo sapiens
PKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVPYCIIKGKARLGRLVHRKTCTTVAFTQVNSEDKGALAKLVEAIRTNYNDRYDENPRHWGGRSWV

SEQ ID NO: 840875 - protein, 178 aa, Homo sapiens
PKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELGFSPCCRKNGGPT

SEQ ID NO: 840876 - protein, 79 aa, Homo sapiens
PKGKKAKGKKVAPAPAVVKKQEAKKVVNPLFEKRPKNFGIGQDIQPKRDLTRFVKWPRYIRLQRQRAILYKRLKVPPAI

SEQ ID NO: 840877 - protein, 216 aa, Homo sapiens
PKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVPYCIIKGKARLGRLVHRKTCTTVAFTQVNSARPKALWA

SEQ ID NO: 840878 - protein, 106 aa, Homo sapiens
PKGKKAKGKKVAPAPAVVKKQEAKKVVNPLFEKRPKNFGIGQDIQPKRDLTRFVKWPRYIRLQQDVGSSQCGVDAVSAALDAVSAALIVSAALDAVSARDQSALRP

SEQ ID NO: 840879 - protein, 112 aa, Homo sapiens
FFLLLTRLKLTLKKTTGGTRGVGRYQEMLPSGIDVHEESWRIRRHEVEMKENVSHKGNICKHQLNSMPTVLGQKNCQGRNYALPAPSSLRIHYIKEEIILKMWKPKQTPILD

SEQ ID NO: 840880 - protein, 114 aa, Homo sapiens
QYFMRYTLLYKAGGLVGNSGTRGVGRYQEMLPSGIDVHEESWRIRRHEVEMKENVSHKGNICKHQLNSMPTVLGQKNCQGRNYALPAPSSLRIHYIKEEIILKMWKPKQTPILD

SEQ ID NO: 840881 - protein, 355 aa, Homo sapiens
SLRCWGARARMAAENEASQESALGAYSPVDYMSITSFPRLPEDEPAPAAPLRGRKDEDAFLGDPDTDPDSFLKSARLQRLPSSSSEMGSQDGSPLRETRKDPFSAAAAECSCRQDGLTVIVTACLTFATGVTVALVMQIYFGDPQIFQQGAVVTDAARCTSLGIEVLSKQGSSVDAAVAAALCLGIVAPHSSGLGGGGVMLVHDIRRNESHLIDFRESAPGALREETLQRSWETKPGLLVGVPGMVKGLHEAHQLYGRLPWSQVLAFAAAVAQDGFNVTHDLARALAEQLHPTCPSASGRRSCHRAARHYLARCCIGPTWLRCWMYLAPPARLPSTQVATSHWRWWPRLSTQGVS

SEQ ID NO: 840882 - protein, 355 aa, Homo sapiens; identical to SEQ ID NO: 840881

SEQ ID NO: 840883 - protein, 619 aa, Homo sapiens
SLRCWGARARMAAENEASQESALGAYSPVDYMSITSFPRLPEDEPAPAAPLRGRKDEDAFLGDPDTDPDSFLKSARLQRLPSSSSEMGSQDGSPLRETRKDPFSAAAAECSCRQDGLTVIVTACLTFATGVTVALVMQIYFGDPQIFQQGAVVTDAARCTSLGIEVLSKQGSSVDAAVAAALCLGIVAPHSSGLGGGGVMLVHDIRRNESHLIDFRESAPGALREETLQRSWETKPGLLVGVPGMVKGLHEAHQLYGRLPWSQVLAFAAAVAQDGFNVTHDLARALAEQLHPTCPSASGRRSCHRAARHYLARCCIVPDLAEVLDVLGTSGPAAFYAGGNLTLEMVAEAQHAGGVITEEDFSNYSALVEKPVCGVYRGHLVLSPPPPHTGPALISALNILEGFNLTSLVSREQALHWVAETLKIALALASRLGDPVYDSTITESMDDMLSKVEAAYLRGHINDSQAAPAPLLPVYELDGAPTAAQVLIMGPDDFIVAMVSSLNQPFGSGLITPSGILLNSQMLDFSWPNRTANHSAPSLENSVQPGKRPLSFLLPTVVRPAEGLCGTYLALGANGAARGLSGLTQHLNRQPALFRVGFERKGLLFSRTPQNGSMNVLRT

SEQ ID NO: 840884 - protein, 386 aa, Homo sapiens
SLRCWGARARMAAENEASQESALGAYSPVDYMSITSFPRLPEDEPAPAAPLRGRKDEDAFLGDPDTDPDSFLKSARLQRLPSSSSEMGSQDGSPLRETRKDPFSAAAAECSCRQDGLTVIVTACLTFATGVTVALVMQIYFGDPQIFQQGAVVTDAARCTSLGIEVLSKQGSSVDAAVAAALCLGIVAPHSSGLGGGGVMLVHDIRRNESHLIDFRESAPGALREETLQRSWETKPSLAWGSAEFSPAPPFQVTWSPLSLAYPPAQPGLLVGVPGMVKGLHEAHQLYGRLPWSQVLAFAAAVAQDGFNVTHDLARALAEQLHPTCPSASGRRSCHRAARHYLARCCIGPTWLRCWMYLAPPARLPSTQVATSHWRWWPRLSTQGVS

SEQ ID NO: 840885 - protein, 355 aa, Homo sapiens; identical to SEQ ID NO: 840881

SEQ ID NO: 840886 - protein, 355 aa, Homo sapiens; identical to SEQ ID NO: 840881

SEQ ID NO: 840887 - protein, 238 aa, Homo sapiens
SNRSYENRCPLLARDPLCSKGFNLTSLVSREQALHWVAETLKIALALASRLGDPVYDSTITESMDDMLSKVEAAYLRGHINDSQAAPAPLLPVYELDGAPTAAQVLIMGPDDFIVAMVSSLNQPFGSGLITPSGILLNSQMLDFSWPNRTANHSAPSLENSVQPGKRPLSFLLPTVVRPAEGLCGTYLALGANGAARGLSGLTQHLNRQPALFRVGFERKGLLFSRTPQNGSMNVLRT

SEQ ID NO: 840888 - protein, 355 aa, Homo sapiens; identical to SEQ ID NO: 840881

SEQ ID NO: 840889 - protein, 261 aa, Homo sapiens
SLRCWGARARMAAENEASQESALGAYSPVDYMSITSFPRLPEDEPAPAAPLRGRKDEDAFLGDPDTDPDSFLKSARLQRLPSSSSEMGSQDGSPLRETRKDPFSAAAAECSCRQDGLTVIVTACLTFATGVTVALVMQIYFGDPQIFQQGAVVTDAARCTSLGIEVLSKQGSSVDAAVAAALCLGIVAPHSSGLGGGGVMLVHDIRRNESHLIDFRESAPGALREETLQRSWETKVGTLVRRESSGESLFIALLLTQALIC

SEQ ID NO: 840890 - protein, 355 aa, Homo sapiens; identical to SEQ ID NO: 840881

SEQ ID NO: 840891 - protein, 355 aa, Homo sapiens; identical to SEQ ID NO: 840881

SEQ ID NO: 840892 - protein, 355 aa, Homo sapiens; identical to SEQ ID NO: 840881

SEQ ID NO: 840893 - protein, 355 aa, Homo sapiens; identical to SEQ ID NO: 840881

SEQ ID NO: 840894 - protein, 355 aa, Homo sapiens; identical to SEQ ID NO: 840881

SEQ ID NO: 840895 - protein, 355 aa, Homo sapiens; identical to SEQ ID NO: 840881

SEQ ID NO: 840896 - protein, 449 aa, Homo sapiens
SLRCWGARARMAAENEASQESALGAYSPVDYMSITSFPRLPEDEPAPAAPLRGRKDEDAFLGDPDTDPDSFLKSARLQRLPSSSSEMGSQDGSPLRETRKDPFSAAAAECSCRQDGLTVIVTACLTFATGVTVALVMQIYFGDPQIFQQGAVVTDAARCTSLGIEVLSKQGSSVDAAVAAALCLGIVAPHSSGLGGGGVMLVHDIRRNESHLIDFRESAPGALREETLQRSWETKGPGLLSPSPTRLAQPGLLVGVPGMVKGLHEAHQLYGRLPWSQVLAFAAAVAQDGFNVTHDLARALAEQLHPTCPSASGRRSCHRAARHYLARVLHRPDLAEVLDVLGTSGPAAFYAGGNLTLEMVAEAQHAGGVITEEDFSNYSALVEKPVCGVYRGDLSPGSQGPPSGEASQSMATSFWPRDSSPFHRRETKAVSYLGSQLLKQTRVSPPSEK

SEQ ID NO: 840897 - protein, 172 aa, Homo sapiens
MLSSHFPFCVSPSGGVMLVHDIRRNESHLIDFRESAPGALREETLQRSWETKPGLLVGVPGMVKGLHEAHQLYGRLPWSQVLAFAAAVAQDGFNVTHDLARALAEQLHPTCPSASGRRSCHRAARHYLARCCIGPTWLRCWMYLAPPARLPSTQVATSHWRWWPRLSTQGVS

SEQ ID NO: 840898 - protein, 175 aa, Homo sapiens
MDDMLSKVEAAYLRGHINDSQAAPAPLLPVYELDGAPTAAQVLIMGPDDFIVAMVSSLNQPFGSGLITPSGILLNSQMLDFSWPNRTANHSAPSLENSVQPGKRPLSFLLPTVVRPAEGLCGTYLALGANGAARGLSGLTQHLNRQPALFRVGFERKGLLFSRTPQNGSMNVLRT

SEQ ID NO: 840899 - protein, 271 aa, Homo sapiens
MPLMAPDLGHPWGPPETKPGRRRDSGNMQSGGLRTRWPPHTGPALISALNILEGFNLTSLVSREQALHWVAETLKIALALASRLGDPVYDSTITESMDDMLSKVEAAYLRGHINDSQAAPAPLLPVYELDGAPTAAQVLIMGPDDFIVAMVSSLNQPFGSGLITPSGILLNSQMLDFSWPNRTANHSAPSLENSVQPGKRPLSFLLPTVVRPAEGLCGTYLALGANGAARGLSGLTQHLNRQPALFRVGFERKGLLFSRTPQNGSMNVLRT

SEQ ID NO: 840900 - protein, 127 aa, Homo sapiens
RCPYIRAEGILSKPNPRVTGTYLALGANGAARGLSGLTQQVLLNVLTLNRNLSDSLARGRLHPDLQSNLLQVDSEFTEEEIEFLEARGHHVEKVDVLSWVHGSRRTNNFIIAVKDPRSPDAAGATIL

SEQ ID NO: 840901 - protein, 189 aa, Homo sapiens
MLSTDSKISQRELATDASKVAPRPGTVAHACNLSTLGGRGVGAGRREVEWAARRRKQAFRRLLIPRRSSLTPGDLNLKSEAPRVLSNPGVEVGWGIPALSDLGDQKDAHLGEWDLPFQSAHPRGPHLEGRTWRTAPPRRARLTPGAQAMWGVRAGRSVPAPHPASMRTREADVAASRDLTIALQPGQQE

SEQ ID NO: 840902 - protein, 238 aa, Homo sapiens
HWIWGHVGGPVKGAPQASLPGAPWLGGQGRTQAGTTRATLRAIVRDRDGAVAIVVTELWYAPATLHSSPGCSHLWQRVGKHMILPSKTVLVRERHQQESQRFLLLSIITITIILITITVTVIIIITIMDFKEVQRISSSGQSESCSVEAGGWVGSPVEAPPVFGFWAGIWGQGRPNAYCRNSLPGKSGSLLGGGSLSSELSGKELVVWFPVSSGDGAGSRGEHSSVDVLILSAGRVRW

SEQ ID NO: 840903 - protein, 111 aa, Homo sapiens
MDFKEVQRISSSGQSESCSVEAGGWVGSPVEAPPVFGFWAGIWGQGRPNAYCRNSLPGKSGSLLGGGSLSSELSGKELVVWFPVSSGDGAGSRGEHSSVDVLILSAGRVRW

SEQ ID NO: 840904 - protein, 1790 aa, Homo sapiens
PVAAVGSRAQTGAILPEAASRSWGRPGGRLKLFFCLFCSLGLGEDLEVWAPSSPLETAMVSSNHHHLTTLHGGAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 840905 - protein, 1021 aa, Homo sapiens
MPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 840906 - protein, 1688 aa, Homo sapiens
PVAAVGSRAQTGAILPEAASRSWGRPGGRLKLFFCLFCSLGLGEDLEVWAPSSPLETAMVSSNHHHLTTLHGGAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 840907 - protein, 1712 aa, Homo sapiens
PVAAVGSRAQTGAILPEAASRSWGRPGGRLKLFFCLFCSLGLGEDLEVWAPSSPLETAMVSSNHHHLTTLHGGAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEVRHISNIWVKTLSNKTFFCKEKNFYIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 840908 - protein, 995 aa, Homo sapiens
MFSPFLSSKGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 840909 - protein, 1761 aa, Homo sapiens
PVAAVGSRAQTGAILPEAASRSWGRPGGRLKLFFCLFCSLGLGEDLEVWAPSSPLETAMVSSNHHHLTTLHGGAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 840910 - protein, 102 aa, Homo sapiens
VATTNSSQARVWQRSCYSRDLEEGIYLQPCRQACIPWPLPWSLKQFTDSVSVTRATVHGQSCLYRNPHSYLRKCSLVLTESHTHPHPDLRPSICRPDCKNMP

SEQ ID NO: 840911 - protein, 44 aa, Homo sapiens
QVSKPDMGLVALEAEGQELLLELEKNHRLLAPGYIETHYGPDGQ

SEQ ID NO: 840912 - protein, 114 aa, Homo sapiens
MRALRPREVKEFANEVAEQDLNPHLPDSKARSFLGKAKRGQGLAVPSPTRTPLVCFERWQAPSLPSSEDKGRAVSPEASLSLVLMVPAHTPSYPSSMNPPPHSGTGLLPGGGIR

SEQ ID NO: 840913 - protein, 372 aa, Homo sapiens
MRVGPVRSAMSGASQPRGPALLFPATRGVPAKRLLDADDAAAVAAKCPRLSECSSPPDYLSPPGSPCSPQPPPAAPGAGGGSGSAPGPSRIADYLLLPLAEREHVSRALCIHTGRELRCKVFPIKHYQDKIRPYIQLPSHSNITGIVEVILGETKAYVFFEKDFGDMHSYVRSRKRLREEEAARLFKQIVSAVAHCHQSAIVLGDLKLRKFVFSTEERTQLRLESLEDTHIMKGEDDALSDKHGCPAYVSPEILNTTGTYSGKAADVWSLGVMLYTLLVGRYPFHDSDPSALFSKIRRGQFCIPEHISPKARCLIRSLLRREPSERLTAPEILLHPWFESVLEPGYIDSEIGTSDQIVPEYQEDSDISSFFC

SEQ ID NO: 840914 - protein, 74 aa, Homo sapiens
AATASPVAFWNQSGGAGHVVRCCVLVQNKVKGSYVPDLVFRASVPEESQPRLVYSAFSWTGPGDTVALLWDGKC

SEQ ID NO: 840915 - protein, 205 aa, Homo sapiens
AATASPVAFWNQSGGAGHVVRCCVLVQNKVKGSYVPDLVFRASVPEESQPRTQLRLESLEDTHIMKGEDDALSDKHGCPAYVSPEILNTTGTYSGKAADVWSLGVMLYTLLVGRYPFHDSDPSALFSKIRRGQFCIPEHISPKARCLIRSLLRREPSERLTAPEILLHPWFESVLEPGYIDSEIGTSDQIVPEYQEDSDISSFFC

SEQ ID NO: 840916 - protein, 62 aa, Homo sapiens
PLANRTWQAAGGSGKARWEEEEDQEPRKKKKEGQPKKGRTEMRGKRENSNEKRISGRSPINH

SEQ ID NO: 840917 - protein, 372 aa, Homo sapiens; identical to SEQ ID NO: 840913

SEQ ID NO: 840918 - protein, 206 aa, Homo sapiens
MHSYVRSRKRLREEEAARLFKQIVSAVAHCHQSAIVLGDLKLRKFVFSTEERTQLRLESLEDTHIMKGEDDALSDKHGCPAYVSPEILNTTGTYSGKAADVWSLGVMLYTLLVGRYPFHDSDPSALFSKIRRGQFCIPEHISPKARCLIRSLLRREPSERLTAPEILLHPWFESVLEPGYIDSEIGTSDQIVPEYQEDSDISSFFC

SEQ ID NO: 840919 - protein, 141 aa, Homo sapiens
MKGEDDALSDKHGCPAYVSPEILNTTGTYSGKAADVWSLGVMLYTLLVGRYPFHDSDPSALFSKIRRGQFCIPEHISPKARCLIRSLLRREPSERLTAPEILLHPWFESVLEPGYIDSEIGTSDQIVPEYQEDSDISSFFC

SEQ ID NO: 840920 - protein, 141 aa, Homo sapiens; identical to SEQ ID NO: 840919

SEQ ID NO: 840921 - protein, 372 aa, Homo sapiens; identical to SEQ ID NO: 840913

SEQ ID NO: 840922 - protein, 77 aa, Homo sapiens
SASLNFSNTEFSTSTLLPSTRPTKYQTVFSQWQVSSCKSKENPDAILPIHTLTETIQEALEKCQIPDDAQDAFGRRP

SEQ ID NO: 840923 - protein, 106 aa, Homo sapiens
MCVCICRWEHLPLAQALCIGVSDQAPGRLPHLASFWQPCRVGTDLLRSWARTYPVACVRGSAAGPLLKRTFRFCPPSFLKCLGSCIFGLRLCCPCSVSGTQNLWGS

SEQ ID NO: 840924 - protein, 182 aa, Homo sapiens
MTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVIFQLRAKQCVACRERAHGAVLRPCQHHILCEPCAATAPECPYCKGQPLQW

SEQ ID NO: 840925 - protein, 229 aa, Homo sapiens
MTCCSQVPPRRRPSLALSPRLDCNGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVKQLQEELEGLGVASTLPGLRGCGDIGTIPLPKLHSLQSQLRLDLEAVDGVIFQLRAKQCVACRERAHGAVLRPCQHHILCEPCAATAPECPYCKGQPLQW

SEQ ID NO: 840926 - protein, 206 aa, Homo sapiens
MVAGRLCTCRHPRLPAQSTIATLAILSAGPPSSSSASPNGAELARVRRQLDEAKRKIRQWEESWQQVKQVCDAWQREAQEAKERARVADSDRQLALQKKEEVEAQVKQLQEELEGLGVASTLPGLRGCGDIGTIPLPKLHSLQSQLRLDLEAVDGVIFQLRAKQCVACRERAHGAVLRPCQHHILCEPCAATAPECPYCKGQPLQW

SEQ ID NO: 840927 - protein, 232 aa, Homo sapiens
MTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVKQLQEELEGLGVASTLPGLRGCGDIGTIPLPKLHSLQSQLRLDLEAVDGVIFQLRAKQCVACRERAHGAVLRPCQHHILCEPCAATAPECPYCKGQPLQW

SEQ ID NO: 840928 - protein, 106 aa, Homo sapiens
SLEQRERPGSPGRVVRSVRGPRRAGQSDRTAGLVPRAQAVTFVPPQARGSAPAPKITQGSPSVPAARESQGCSPPFMLPVGCTSLKASSMEPITFHRGQFPGPQTR

SEQ ID NO: 840929 - protein, 605 aa, Homo sapiens
MVRHQPLQYYEPQLCLSCLTGIYGCRWKRYQRSHDDTTPWERLWFLLLTFTFGLTLTWLYFWWEVHNDYDEFNWYLYNRMGYWSDWPVPILVTTAAAFAYIAGLLVLALCHIAVGQQMNLHWLHKIGLVVILASTVVAMSAVAQLWEDEWEVLLISLQGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 840930 - protein, 276 aa, Homo sapiens
MGPPHTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 840931 - protein, 605 aa, Homo sapiens; identical to SEQ ID NO: 840929

SEQ ID NO: 840932 - protein, 259 aa, Homo sapiens
MVRHQPLQYYEPQLCLSCLTGIYGCRWKRYQRSHDDTTPWERLWFLLLTFTFGLTLTWLYFWWEVHNDYDEFNWYLYNRMGYWSDWPVPILVTTAAAFAYIAGLLVLALCHIAVGQQMNLHWLHKIGLVVILASTVVAMSAVAQLWEDEWEVLLISLQGTAPFLHVGAVAAVTMLSWIVAGQFARAERTSSQVTILCTFFTVVFALYLAPLTISSPCIMEKKDLGPKPALIGHRGAPMASGEPSRRAGRQLRAHCDSEY

SEQ ID NO: 840933 - protein, 75 aa, Homo sapiens
AVGTELAHVVVYARCASTIDFLKRYASNIPSGEFQTADEDLCYCLECVAEYHKARDELPFLHEVKYIRWAIFFRA

SEQ ID NO: 840934 - protein, 605 aa, Homo sapiens; identical to SEQ ID NO: 840929

SEQ ID NO: 840935 - protein, 641 aa, Homo sapiens
MVRHQPLQYYEPQLCLSCLTGIYGCRWKRYQRSHDDTTPDSVWACTLQGPDSEEVLGQDLLNEQLEGGLSICVHEWERLWFLLLTFTFGLTLTWLYFWWEVHNDYDEFNWYLYNRMGYWSDWPVPILVTTAAAFAYIAGLLVLALCHIAVGQQMNLHWLHKIGLVVILASTVVAMSAVAQLWEDEWEVLLISLQGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 840936 - protein, 159 aa, Homo sapiens [sequence omitted]

SEQ ID NO: 840937 - protein, 164 aa, Homo sapiens
MSELTFTIATKRIKYLGIQLIRDVKDLFKENDKLLLKEIREDTNKWKSIPCLWIGRINIVKMGIPPKVIYRFNAIPIKLPMTFFTELEKTTLRFIWNQKKSLHSQDNPKQKEKRWRHRATLLQTILQGYSNQNSMLLVPKQIYRPMEQNRGLRNNTTHLQPSDL

SEQ ID NO: 840938 - protein, 72 aa, Homo sapiens
QPVRASICTLGSIASEDTRGKTATPQVAEPSPPHLARDSSSKVMISLIKRAAPNSPPEAKEPFFFFSLKSPF

SEQ ID NO: 840939 - protein, 70 aa, Homo sapiens
YGYTKSHFRGHPGQGSAKAFWKGPDDTHFGLCKPLTASVTSSCCCCERPFKNVKTILRNLVVQRQTHRLD

SEQ ID NO: 840940 - protein, 151 aa, Homo sapiens
MEYVLEVKNSPRHLLKQFTVCDVPLYDICDYNVSRDRCQELGCCFYEGVCYKKAVPIYIHVFSALIVIIAGAFVITIIYRVIQESRKEKAIPVDVALPQKSSEKAELASSSSKLGLKPASPGPPSAGPSMKSDEDKDDVTGTITEAEETED

SEQ ID NO: 840941 - protein, 128 aa, Homo sapiens
FTGEFSWKKNLMPAICQGRQEVTVQAQCARPLHLSAAAMEYVLEVKNSPRHLLKQFTVCDVPLYDICDYNVSRDRCQELGCCFYEGVCYKKAVPKSFRRAGKKRPSLWMSRCHRSPAKRRSWPHPAAS

SEQ ID NO: 840942 - protein, 178 aa, Homo sapiens
MFLCMTFVTTTSPGTDARSSGAASTKASATRKRFPFRGGIDLGIEEPFPGSWGAQQEQRGQRHLSTHPQGSGASTIYPPHTPEVYIHVFSALIVIIAGAFVITIIYRVIQESRKEKAIPVDVALPQKSSEKAELASSSSKLGLKPASPGPPSAGPSMKSDEDKDDVTGTITEAEETED

SEQ ID NO: 840943 - protein, 140 aa, Homo sapiens
CPDLPPPLPRVPTLHSCSLPLTPHSAARGIPNAEPVFLLLRTFVAPWCSQQKSQTPQLRIQGPSGPRLCCPAFQVHELRRAPRKPSGKAKDHDVDYCTSPASPPYLTLHVTLLSLKPFPLASIRDSTSFWAFFSLFLEVS

SEQ ID NO: 840944 - protein, 119 aa, Homo sapiens
PSCLISQPPCRAPALRSGLSLLCPLDTVCPELLLYLPNKDWCTLKPSWMSHLTSSPCPHLLSEFLQPIAPATLSGTTFHYQELGKLAKVSTLLFTAVSASHKMLPTSQGCVKSKMRKCI

SEQ ID NO: 840945 - protein, 104 aa, Homo sapiens
LPGKEGRGAWQVWNPPSSSGIPGPTSMYKWDGEGPGQCGFTFTGNGWELLRHSECQAHGTQLAFGQACTAVLVRNLTSALWGRWVEWLKLETDQRSSWTQTEGG

SEQ ID NO: 840946 - protein, 70 aa, Homo sapiens
RTYAGGWDLPQGLSKETRPRCNASAVDHTRARPKTPNHSPSSPASQTAGFSKPPFLLSVSSAELHVPLLL

SEQ ID NO: 840947 - protein, 218 aa, Homo sapiens
MSALGAVIALLLWGQLFAVDSGNDVTDIADDGCPKPPEIAHGYVEHSVRYQCKNYYKLRTEGDGVYTLNNGKQWINKAVGDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 840948 - protein, 118 aa, Homo sapiens
MCIPAFSQFIFLISYPHGPVSSAGLHNMGGDPITVIDEIRDLLYIGKDRKNPREDYLDVYVFGVGPLVNQVNINALASKKDNEQHVFKVKDMENLEDVFYQMIGREIQGNKEHNSPQV

SEQ ID NO: 840949 - protein, 764 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 840950 - protein, 542 aa, Homo sapiens
MYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 840951 - protein, 416 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRK

SEQ ID NO: 840952 - protein, 836 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGKDATEGPGLHLCSPGNTSHFLQILHSTHPQCSPIPCTPDQSGMGEDVKLGMTRGQRQEAAHKEVVTYSPTSGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 840953 - protein, 354 aa, Homo sapiens
RGLPTQVKQGGYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 840954 - protein, 253 aa, Homo sapiens [sequence omitted]

SEQ ID NO: 840955 - protein, 764 aa, Homo sapiens; identical to SEQ ID NO: 840949

SEQ ID NO: 840956 - protein, 764 aa, Homo sapiens; identical to SEQ ID NO: 840949

SEQ ID NO: 840957 - protein, 626 aa, Homo sapiens [sequence omitted]

SEQ ID NO: 840958 - protein, 763 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLSIRGFLLDRGVGLN

SEQ ID NO: 840959 - protein, 744 aa, Homo sapiens [sequence omitted]

SEQ ID NO: 840960 - protein, 626 aa, Homo sapiens [sequence omitted]

SEQ ID NO: 840961 - protein, 662 aa, Homo sapiens [sequence omitted]

SEQ ID NO: 840962 - protein, 484 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIGREIQGNKEHNSPQV

SEQ ID NO: 840963 - protein, 247 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGSLC

SEQ ID NO: 840964 - protein, 122 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRGLRAMSVGSGLRQKQGRRQQGQD

SEQ ID NO: 840965 - protein, 115 aa, Homo sapiens
MGIKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 840966 - protein, 743 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVYHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 840967 - protein, 666 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 840968 - protein, 753 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 840969 - protein, 320 aa, Homo sapiens
LKQTWQAKISVIRPSKGHESCMGAVDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 840970 - protein, 764 aa, Homo sapiens; identical to SEQ ID NO: 840949

SEQ ID NO: 840971 - protein, 764 aa, Homo sapiens; identical to SEQ ID NO: 840949

SEQ ID NO: 840972 - protein, 701 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRVLAAP

SEQ ID NO: 840973 - protein, 732 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRPG

SEQ ID NO: 840974 - protein, 641 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKRQL

SEQ ID NO: 840975 - protein, 668 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKPGLGEPSEHQCFGFKKDNEQHVFKVKDMENLEDVFYQMIDESQSLSLCGMVWEHRKGTDYHKQPWQAKISVNSPFKGTRELFGGLGV

SEQ ID NO: 840976 - protein, 305 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVESSYP

SEQ ID NO: 840977 - protein, 72 aa, Homo sapiens
SEPPDRHRGHMGLGRKISLINNGLVDVAWVYSFLVLDSYIRDIHSPTIHEKNWPDTVGFLIRAGAQHMACPH

SEQ ID NO: 840978 - protein, 405 aa, Homo sapiens
MILSFTVTWTLRSLGWGEGSTLGIGRAGRSVQAGSCWGINKGGRATLFFFFAVARAGFCQGSIANGAGVHLGPRTPADSPLLAPTAAGFSAPRLPRSAGSSRYRQAAAGAAFALNLAGACAAGRPGQAGRRGGGARHARPAAPRLGFPSAAPAERPAAAPVKRKRRRRRRRRRRRRPLGKLPDPAASAGPMADSSPALSLREGGPRAPRPSAPSPPPRSRSGSESEEAELSLSLARTKTRSYGSTASVRAPLGAGVIERHVEHRVRAGDTLQGIALKYGVTMEQIKRANKLFTNDCIFLKKTLNIPVISEKPLLFNGLNSIDSPENETADNSFSQEEEPVVAGEDLPPPSPQESDVQPVQPEEVSARDFLQRLDLQIKLSTQAAKKLKEESRDEESPYATSLYHS

SEQ ID NO: 840979 - protein, 124 aa, Homo sapiens
MEQIKRANKLFTNDCIFLKKTLNIPVISEKPLLFNGLNSIDSPENETADNSFSQEEEPVVAGEDLPPPSPQESDVQPVQPEEVSARDFLQRLDLQIKLSTQAAKKLKEESRDEESPYATSLYHS

SEQ ID NO: 840980 - protein, 143 aa, Homo sapiens
EFILDYIKTNSPPNLLRHSMEQIKRANKLFTNDCIFLKKTLNIPVISEKPLLFNGLNSIDSPENETADNSFSQEEEPVVAGEDLPPPSPQESDVQPVQPEEVSARDFLQRLDLQIKLSTQAAKKLKEESRDEESPYATSLYHS

SEQ ID NO: 840981 - protein, 405 aa, Homo sapiens; identical to SEQ ID NO: 840978

SEQ ID NO: 840982 - protein, 429 aa, Homo sapiens
MILSFTVTWTLRSLGWGEGSTLGIGRAGRSVQAGSCWGINKGGRATLFFFFAVARAGFCQGSIANGAGVHLGPRTPADSPLLAPTAAGFSAPRLPRSAGSSRYRQAAAGAAFALNLAGACAAGRPGQAGRRGGGARHARPAAPRLGFPSAAPAERPAAAPVKRKRRRRRRRRRRRRPLGKLPDPAASAGPMADSSPALSLREGGPRAPRPSAPSPPPRSRSGSESEEAELSLSLARTKTRSYGSTASVRAPLGAGVIERHVEHRVRAGDTLQGTFGGFKVRGGHGLGTRNLEGGPIKPVLPTVDWVLFSCNENSFVEPFPRFIFQEESLCVVYTWDLTLHVISSEREVDNGVDYSSFSQEEEPVVAGEDLPPPSPQESDVQPVQPEEVSARDFLQRLDLQIKLSTQAAKKLKEESRDEESPYATSLYHS

SEQ ID NO: 840983 - protein, 69 aa, Homo sapiens
KSEIWMTRSPLTFERDSYPSFSWRSDHQLVDVNGRSSGNVLHCCRDLMQRRFWGCTRVLMTEGAPSTES

SEQ ID NO: 840984 - protein, 370 aa, Homo sapiens
MAITLEEAPWLGWLLVKALMRFAFMVVNNLVAIPSYICYVIILQPLRVLDSKRFWYIEGIMYKWLLGMVASWGWYAGYTVMEWGEDIKAVSKDEAVMLVNHQATGDVCTLMMCLQDKGLVVAQMMWLMDHIFKYTNFGIVSLVHGDFFIRQGRSYRDQQLLLLKKHLENNYRSRDRKWIVLFPEGGFLRKRRETSQAFAKKNNLPFLTNVTLPRSGATKIILNALVAQQKNGSPAGGDAKELDSKSKGLQWIIDTTIAYPKAEPIDIQTWILGYRKPTVTHVHYRIFPIKDVPLETDDLTTWLYQRFVEKEDLLSHFYETGAFPPSKGHKEAVSREMTLSNLWIFLIQSFAFLSGYMWYNIIQYFYHCLF

SEQ ID NO: 840985 - protein, 110 aa, Homo sapiens
MPSFFFFFFFFFFFETESQSVAQTGVQWRDLGSLQAPPPGFTPSPASASRVTGTTGARHHARLIFCIFSRDGVSLCSPGWSRSPDLVIRARPPVAFEEGKVKFLFLENIF

SEQ ID NO: 840986 - protein, 197 aa, Homo sapiens
LPASPGERGRALGDRVSAPPGNGRGPRHSRSGAGPRHRLLPPAPPPAMHSSGSSDSQSPGWGPASPRKAAARGVGRQRARSRSASGRLGRHRVHDRDPSAGDTRPRSPQPPAVRARRGEPGARAAPAATTLPHPRKPLQAPPAPRAAVASSLPLSSSPASLPSGRKSHSLHPQFLGFYLFLAFAPFPLLLSFLFFAL

SEQ ID NO: 840987 - protein, 114 aa, Homo sapiens
MVIRVYIASSSGSTAIKKKQQDVLGFLEANKIGFEEKDIAANEENRKWMRENVPENSRPATGYPLPPQIFNESQYRGDYDAFFEARENNAVYAFLGLTAPPGSKEAEVQAKQQA

SEQ ID NO: 840988 - protein, 151 aa, Homo sapiens
MDQDGEIEDSTNHPLHTNTNLTTIYMHTHKSFINLTTIYMHTHKTFVRTQNQIKKKQQDVLGFLEANKIGFEEKDIAANEENRKWMRENVPENSRPATGYPLPPQIFNESQYRGDYDAFFEARENNAVYAFLGLTAPPGSKEAEVQAKQQA

SEQ ID NO: 840989 - protein, 119 aa, Homo sapiens
EKQTELPRFDIQRKATDKSGSGPPHPVGWRHSPANKIGFEEKDIAANEENRKWMRENVPENSRPATGYPLPPQIFNESQYRGDYDAFFEARENNAVYAFLGLTAPPGSKEAEVQAKQQA

SEQ ID NO: 840990 - protein, 69 aa, Homo sapiens
GFGLELQRLESSVEAAKGGGGALASSPSTFPHPSLPTAVSAPSWIPAIAAAAPQPFSGPKQPQPLFPGW

SEQ ID NO: 840991 - protein, 114 aa, Homo sapiens; identical to SEQ ID NO: 840987

SEQ ID NO: 840992 - protein, 114 aa, Homo sapiens; identical to SEQ ID NO: 840987

SEQ ID NO: 840993 - protein, 114 aa, Homo sapiens; identical to SEQ ID NO: 840987

SEQ ID NO: 840994 - protein, 114 aa, Homo sapiens; identical to SEQ ID NO: 840987

SEQ ID NO: 840995 - protein, 141 aa, Homo sapiens
FLPCWTLPAFERRTSSSSVLGLGLALLDPQLAEMPIVEPCDHIKKKQQDVLGFLEANKIGFEEKDIAANEENRKWMRENVPENSRPATGYPLPPQIFNESQYRGDYDAFFEARENNAVYAFLGLTAPPGSKEAEVQAKQQA

SEQ ID NO: 840996 - protein, 114 aa, Homo sapiens; identical to SEQ ID NO: 840987

SEQ ID NO: 840997 - protein, 75 aa, Homo sapiens
VEICLGIKQRRPQSTTISAQEGLGNSGCWSGQAVAPNAWSSAWMWSEEAPLHQDLYTGRMAVAQAAEPGSSYMGG

SEQ ID NO: 840998 - protein, 105 aa, Homo sapiens
MCFHLKKRLDDAPCPAASQSLCVSVYQRSHDQEGPCGFGACSLPARSSLGLSCGSLSRFSAPQPKGLGTSHESCRLPYTHCHREAAVDSFVPLWALLWEQSLLGS

SEQ ID NO: 840999 - protein, 106 aa, Homo sapiens
KLVKNADCWVHPASDAIGLGLEILLSNEFPGDADANDVKPALHIRENRCLKVLLNCYRLVDPTFPSLVCFLRKGSFLFILLYSSYYIGCWLAQSGSSRKIVDQSSY

SEQ ID NO: 841000 - protein, 106 aa, Homo sapiens; identical to SEQ ID NO: 840999

SEQ ID NO: 841001 - protein, 105 aa, Homo sapiens
LAANDSLNSPPLHTAIMNGTVTIRVRKFMSNRLLQRKQMVIDVLHPGKATVPKTEIQGKLAKMYKTIPDVIFVFGFRAHFGGGKTTGFGMIYDSLDYAEKNESKH

SEQ ID NO: 841002 - protein, 616 aa, Homo sapiens
CFECGQQHWTRENHLYNYQNEVDDDLVCHICLQPLLQPLDTPCGHTFCYKCLRNFLQEKDFCPLDRKRLHFKLCKKSSILVHKLLDKLLVLCPFSSVCKDVMQRCDLEAHLKNRCPGASHRRVALERRKTSRTQAEIENENGPTLLDPAGTLSPEADCLGTGAVPVERHLTSASLSTWSEEPGLDNPAFEESAGADTTQQPLSLPEGEITTIEIHRSNPYIQLGISIVGGNETPLINIVIQEVYRDGVIARDGRLLAGDQILQVNNYNISNVSHNYARAVLSQPCNTLHLTVLRERRFGNRAHNHSDSNSPREEIFQVALHKRDSGEQLGIKLVRRTDEPGVFILDLLEGGLAAQDGRLSSNDRVLAINGHDLKYGTPELAAQIIQASGERVNLTIARPGKPQPGNTIREAGNHSSSSQHHTPPPYYSRPSSHKDLTQCVTCQEKHITVKKEPHESLGMTVAGGRGSKSGELPIFVTSVPPHGCLARDGRIKRGDVLLNINGIDLTNLSHSEAVAMLKASAASPAVALKALEVQIVEEATQNAEEQPSTFSENEYDASWSPSWVMWLGLPSTLHSCHDIVLRRSYLGSWGFSIVGGYEENHTNQPFFIKTIVLGTP

SEQ ID NO: 841003 - protein, 87 aa, Homo sapiens
MHKGQSSNAEGGTEAGPEEEYSETDAPGGLRRMGLGKTATPRPSLRHNPRGTPTHLHLPYLAEVRSGAGRSLKTSLTLMPANPTRES

SEQ ID NO: 841004 - protein, 30 aa, Homo sapiens
MVLPQLTRPARALPLSAVSVNVYTGIPSPP

SEQ ID NO: 841005 - protein, 150 aa, Homo sapiens
ISSKCTMKEFSSTAQGNTEVIHTGTLQRHERHHIGDFSFQEIEKDIHNFEFQWQEDERNGHEAPMTKIKKLMGSTEQYDHRHAGNKPIKYQLGSSFHSHLSELHIFQPKGKINNQVEKSINDASSVSTAQRISCRPKTHISNNYGDNFLN

SEQ ID NO: 841006 - protein, 211 aa, Homo sapiens
HIRENSYQCEECGKAFKWFSTLTRHKRIHTGEKPFKCEECGKALKQSSTLTTHKIIHTGEKPYRCEECGKAFNRSSHLTTHKIIHTGEKPYKCEECGKAFNQSSTLSTHKFIHAGEKPYKCEECDKAFNRSSNLTKHKIIHTGEKSYKCEECGKAFNQSSTLTKHRKIHTRQKPYNCEECDNTFNQSSNLIKQNNSYWRETLQMSRMWESL

SEQ ID NO: 841007 - protein, 62 aa, Homo sapiens
FSQSSILTTHKRIHTGEKPYKCEECGKAFNRSSNLTKHKIIHTGEKSYKCEECGKAFNQSST

SEQ ID NO: 841008 - protein, 69 aa, Homo sapiens
LAPTLLSIPQKSTVLPHVSTFTPSQGTRQSHQLTASAEEFILSMLGPGADDDPRVLRYSSKTVLPDLQG

SEQ ID NO: 841009 - protein, 31 aa, Homo sapiens
VNVKKSNLWAMQQSRALTLKGLSISSFSPSH

SEQ ID NO: 841010 - protein, 116 aa, Homo sapiens
INHHPSIHPSTIHPSSVHPSIHPSIIHPSMLYPFLHQFSIHLSIVYPSILCPFHLSIYPLSIHPSSVYPLSMNYSSINPSSIHPSILYSSVHHSPIHLPTHPSIRPSDPSWRSMRK

SEQ ID NO: 841011 - protein, 97 aa, Homo sapiens
MGLETSMGHLEFLGPSCSSLLRKTSVPQAQLMASPPISLRKPKQPGEGHLPVSTHGLSPPPQNHYKTRCLTPFYSRVVTAGHTHCLHPCSRSPTRLE

SEQ ID NO: 841012 - protein, 96 aa, Homo sapiens
KGDTKKAGNISLKLHSRQVLETGFHSHSSLQHQSPSYSAYFTYRGWELGDENSNLLYIWGEEYNDMFTKHFYHYVLYLSTHYREEINSEKEFITLQ

SEQ ID NO: 841013 - protein, 691 aa, Homo sapiens
MGQALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 841014 - protein, 686 aa, Homo sapiens
MGQALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYSPGTKLLALPHCVRQASKTASTYLEQENLPPKVICHSLHRIIKCYIFIC

SEQ ID NO: 841015 - protein, 610 aa, Homo sapiens
MGQALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLGNALWPHQTPPDTHTHMAPALGSSSHRAPPAVSRDGFEPLLLTLMFSLIHSFNTYLLGLKQEKNTMPTAVR

SEQ ID NO: 841016 - protein, 721 aa, Homo sapiens
MGQGEPSQRSTGLAGLYAAPAASPVFIKGSGMDALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 841017 - protein, 194 aa, Homo sapiens
MGQALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNRGKFGPGPAWAAWRLQTLELGCSSGREHLHQAPVAALSKDSTNTQSVPGLSP

SEQ ID NO: 841018 - protein, 68 aa, Homo sapiens
TEDRKRKLEELLNSVGQKVSELKEKFQSRTSEAAKLEAEVSKAQETIKAAEVLINQLDREHKRWNAQV

SEQ ID NO: 841019 - protein, 298 aa, Homo sapiens
MERLTLPLGGAAAVDEYLEYRRIVGEDDGGKLFTPEEYEEYKRKVLPLRLQNRLFVSWRSPTGMDCKLVGPETLCFCTHRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIGVPSVEFLESPITAVDSPFLKAFQASSSSSPETLTDVGTSSQVSSLRRPEEDDMAFFERRYQERMKMEKAAKWKGKAPLPSATKPS

SEQ ID NO: 841020 - protein, 262 aa, Homo sapiens
MERLTLPLGGAAAVDEYLEYRRIVGEDDGGKLFTPEEYEEYKRKVLPLRLQNRLFVSWRSPTGMDCKLVGPETLCFCTHRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIVGTSSQVSSLRRPEEDDMAFFERRYQERMKMEKAAKWKGKAPLPSATKPS

SEQ ID NO: 841021 - protein, 262 aa, Homo sapiens; identical to SEQ ID NO: 841020

SEQ ID NO: 841022 - protein, 204 aa, Homo sapiens
MERLTLPLGGAAAVDEYLEYRRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIVGTSSQVSSLRRPEEDDMAFFERRYQERMKMEKAAKWKGKAPLPSATKPS

SEQ ID NO: 841023 - protein, 262 aa, Homo sapiens; identical to SEQ ID NO: 841020

SEQ ID NO: 841024 - protein, 125 aa, Homo sapiens
PNTGLNFNMGFRYLESNIQYIALPKDAEILIPSTVTGTLFGGRVVWKNQTAFPLLSHHKCQHSCDSCDERAEDFSPPASRHSVLQRRQLGVPQSSSIPAWSICRQHKIPQGEGSVPQDSHHFFFF

SEQ ID NO: 841025 - protein, 147 aa, Homo sapiens
MVWIRCCSVPESPSIPLTSFIAWHRCIHSRLSSSTCVLCWQEVCLGKPGSLVGDPSDLPCSLVAPGSRARHSLQCLPWLYTVNQTLVCRGFGEHGGGNVTISGLPGCGLMPQGQDQSLSCVCRSGMVSVWSSWCCPFLSTSVTTHLV

SEQ ID NO: 841026 - protein, 428 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPSWYLG

SEQ ID NO: 841027 - protein, 428 aa, Homo sapiens; identical to SEQ ID NO: 841026

SEQ ID NO: 841028 - protein, 428 aa, Homo sapiens; identical to SEQ ID NO: 841026

SEQ ID NO: 841029 - protein, 428 aa, Homo sapiens; identical to SEQ ID NO: 841026

SEQ ID NO: 841030 - protein, 428 aa, Homo sapiens; identical to SEQ ID NO: 841026

SEQ ID NO: 841031 - protein, 530 aa, Homo sapiens
LAASSRRLRPPPRRGPSALAPAPASPPRSSAMDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPLNGSGQLKMPSHCLSAQMLAPPPPGLPRLALPPATKPATTSEGGATSPTSPSYSPPDTSPANRSFVGLGPRDPAGIYQAQSWYLG

SEQ ID NO: 841032 - protein, 321 aa, Homo sapiens
AGYSRGPRTGRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPPTLRPTRPLQTVPLWD

SEQ ID NO: 841033 - protein, 327 aa, Homo sapiens
ASELTLEDKPDRGGVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPPTLRPTRPLQTVPLWD

SEQ ID NO: 841034 - protein, 365 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPANRSFVGLGPRDPAGIYQAQSWYLG

SEQ ID NO: 841035 - protein, 403 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRFCDPGTSC

SEQ ID NO: 841036 - protein, 159 aa, Homo sapiens
ASPLPSPIRSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPSWYLG

SEQ ID NO: 841037 - protein, 128 aa, Homo sapiens
ELAVFHRDVHMLLVDLELLLGIAKGLGKDNQRSFQALYTANQMVNVCDPAQPETFPVAQALASRFFGQHGGESQHTIHATGHCHIDTGRTATWTAYSPPDTSPANRSFVGLGPRDPAGIYQAQSWYLG

SEQ ID NO: 841038 - protein, 103 aa, Homo sapiens
MQLAPAPPPPTPGIGGPPTSPGSTPKGRDPHCTHCKKCTFRGRGWGSPDTQSSPSWGCPSGAPPSAPGGGRWRGATRTNSLPNFAWCLVKDSCDLAPEVSWRR

SEQ ID NO: 841039 - protein, 459 aa, Homo sapiens
PEHYSALFSGTMTILFSAPAPAGPAPPAAPGMYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPSWYLG

SEQ ID NO: 841040 - protein, 428 aa, Homo sapiens; identical to SEQ ID NO: 841026

SEQ ID NO: 841041 - protein, 428 aa, Homo sapiens; identical to SEQ ID NO: 841026

SEQ ID NO: 841042 - protein, 439 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPPTLRPTRPLQTVPLWD

SEQ ID NO: 841043 - protein, 511 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPLNGSGQLKMPSHCLSAQMLAPPPPGLPRLALPPATKPATTSEGGATSPTSPFLVSGIAKVFFPRPFSIVPGIPGGSTAGPRPTFSVEN

SEQ ID NO: 841044 - protein, 439 aa, Homo sapiens; identical to SEQ ID NO: 841042

SEQ ID NO: 841045 - protein, 538 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPLNGSGQLKMPSHCLSAQMLAPPPPGLPRLALPPATKPATTSEGGATSPTSPSYSPPDTSPANRSFVGLGPRDPAGIYQAQAPQNQPEEEAGMEAASPEFRGDPCAMGGGNPGSGA

SEQ ID NO: 841046 - protein, 337 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGVETFLRMVQCRSVEGCGF

SEQ ID NO: 841047 - protein, 116 aa, Homo sapiens
KTRLSSQTSLRSLANPLAPKEKDPGPSPITPKRGSPSSGLEPLVPPSVCPRGPLPRWPLGIKAWAALREGGRGRGWSGCAIGVSGSFSARVGVVEWGREASRAPEGSGRDENQLFT

SEQ ID NO: 841048 - protein, 104 aa, Homo sapiens
MVIMLIGNKSDLESRRDVKREEGEAFAREHGLIFMETSAKTACNVEEAFINTAKEIYRKIQQGLFDVHNEFPLRIRVKDILFEHLQLPRSSWPLVDRSSASEFH

SEQ ID NO: 841049 - protein, 225 aa, Homo sapiens
LVREVHTLEGVPGLRDSGSVLSLSGVGKSCLLLQFTDKRFQPVHDLTIGVEFGARMVNIDGKQIKLQIWDTAGQESFRSITRSYYRGAAGALLVYDITRRETFNHLTSWLEDARQHSSSNMVIMLIGNKSDLESRRDVKREEGEAFAREHGLIFMETSAKTACNVEEAFINTAKEIYRKIQQGLFDVHNEANGIKIGPQQSISTSVGPSASQRNSRDIGSNSGCC

SEQ ID NO: 841050 - protein, 136 aa, Homo sapiens
MEFTLVTQARAQWHDLVLLQPPPPGFKRFSCLSLPSSWDYSDLESRRDVKREEGEAFAREHGLIFMETSAKTACNVEEAFINTAKEIYRKIQQGLFDVHNEANGIKIGPQQSISTSVGPSASQRNSRDIGSNSGCC

SEQ ID NO: 841051 - protein, 174 aa, Homo sapiens
MTYAYLFKYIIIGDTGVGKSCLLLQFTDKRFQPVHDLTIGVEFGARMVNIDGKQIKLQIWDTAGQESFRSITRSYYRGAAGALLVYDITRRETFNHLTSWLEDARQHSSSNMVIMLIGNKSDLESRRDVKREEGEAFAREHGLIFMETSAKTACNVEELPKCWITGVSHRAWPK

SEQ ID NO: 841052 - protein, 216 aa, Homo sapiens
MTYAYLFKYIIIGDTGVGKSCLLLQFTDKRFQPVHDLTIGVEFGARMVNIDGKQIKLQIWDTAGQESFRSITRSYYRGAAGALLVYDITRRETFNHLTSWLEDARQHSSSNMVIMLIGNKSDLESRRDVKREEGEAFAREHGLIFMETSAKTACNVEEAFINTAKEIYRKIQQGLFDVHNEANGIKIGPQQSISTSVGPSASQRNSRDIGSNSGCC

SEQ ID NO: 841053 - protein, 216 aa, Homo sapiens; identical to SEQ ID NO: 841052

SEQ ID NO: 841054 - protein, 216 aa, Homo sapiens; identical to SEQ ID NO: 841052

SEQ ID NO: 841055 - protein, 138 aa, Homo sapiens [sequence omitted]

SEQ ID NO: 841056 - protein, 103 aa, Homo sapiens
LVREVHTLEGVPGLRDSGSVLSLSGVGKSCLLLQFTDKRFQPVHDLTIGVEFGARMVNIDGKQIKLQIWDTAGQESFRSITRSYYRGAAPKVLDYRCEPPCLA

SEQ ID NO: 841057 - protein, 216 aa, Homo sapiens; identical to SEQ ID NO: 841052

SEQ ID NO: 841058 - protein, 216 aa, Homo sapiens; identical to SEQ ID NO: 841052

SEQ ID NO: 841059 - protein, 112 aa, Homo sapiens
PTSASGETSGCFYLWRKMKQVQALTHGKSRSKRENVCRGRCHTLLNEQISRELKTRVHLLPRGWPKPFMGGSAPMIQTPPTRPHVKRWGLPFNMRFRWGQICKLYQLVNMRS

SEQ ID NO: 841060 - protein, 52 aa, Homo sapiens
ISFEILSFLWRHHVSKAWSSVRKDLVEICSLEGATDRCYQHISGKWVQHRLQ

SEQ ID NO: 841061 - protein, 1209 aa, Homo sapiens
MFLMNASPVVALQSKWEAFGPPGSCRFPRCFSEADEGVESASVSARVQMLISTLQRDGAARGTSDERAAQRGHRAEGCHDARPAAKPTVHKEPPALAVCGLVADFDPMGEEETTDFGPLVLDSDSDDSVDRDIEEAIQEYLKAKSGAAQPGAGGAQPGAAQPSRAAGGGSRCKPEPAHGSAPTALCPPKLVPGSGGGPGSQVGSSKDQGSASPVSVSSDDSFEQSIRAEIEQFLNEKRQHETQKCDGSVEKKPDTNENSAKSLLKSHQEPPTKVVHRQGLLGVQKEFAFRKPPRLAKMNVQPRSLRSKVTTTQENEGSTKPATPCRPSEAAQNKGGIKRSASAARRGKRVMSAAQASEASDSSSDDGIEEAIQLYQLQKTRKEADGDLPQRVQLREERAPDPPAHSTSSATKSALPETHRKTPSKKKLVATKTMDPGPGGLDTDHAPKLLKETKAPPPASPASRSEFVERSSCRADTSAELMCAEAILDISKTILPAPVEGSDGSLSASPLFYSPNVPSRSDGDSSSVDSDDSIEQEIRTFLALKAQSGSLLARGESCPQAAQGPLLPPGLNSQTGGHKTPLSKTPDPLLGCKRKRRGGGHVRPSTPKKMQEVVKDGSQDADHSQGRAEPGHERRDLPIQGKASEALGGEGTARGPGDTRMSQGQGKTDEARRLDEKESSEDKSSSLDSDEDLDTAIKDLLRSKRKLKKRCREPRAACRKKVRFSTAQTHFLEQLGGLRRDWKDRGPPVLKSCLSKSKRDSGEGPGKKPPSVFGSTAERMRQEGAASQDAALAFRVRRPASASASEGNPFPRESQGPAPSPGSLSDDSSSVDSNDSIELEIRKFLAEKAKESVSSSEVQAEGPTALGTGGPARPEVLCRKEPAPPPGVCTRSQRARGVPHLAEGLRGTESAGAQGTAGLFSQGGKGLPAAPARGDPVPPRSTSGGVSAKGLSVSRRNVYVHKDQSPRGAEPAAKSAFGQLPSCATAGTEAGGARGTFHMGCGSPSFLTPSPGAERDAGAQADRTPPWSDFAHQSRLPSPWVLRSEGRDAVWRGGVGSERDKGSEGPARGLPSLPLAGFSPLLSTQLFHFGKGVSWGGRQAGLFSPHLGLPLQGPSFSAFREAQAGPSPVFGSPHLLAKKDGGPWPTRKAQAGLSLHDRRSSGSEESILDLRYRRRVNRDDQEQDALGSDASDFSDTSTEDSGGSSVVKV

SEQ ID NO: 841062 - protein, 1209 aa, Homo sapiens; identical to SEQ ID NO: 841061

SEQ ID NO: 841063 - protein, 76 aa, Homo sapiens
RPPQKKKPRPPPVLRLEETSSASLDLPKREKEQQEATEHIDEVQNEIDRLNELREEILKAEQKINSVSHFFRRGEN

SEQ ID NO: 841064 - protein, 44 aa, Homo sapiens
GKPHCSRNPVLVRGIGRYCRSAMYSRKAMYKRKYSAAKSKVEKK

SEQ ID NO: 841065 - protein, 497 aa, Homo sapiens
MVPVAYNDKIVAFLRQPNIFEILQERQPDLTRNHSLREKIQFIRTEGTPGLVRLSSDADLVMLLSLFEEEIMSYVPPHALLHPSYCQSPRGSPVSSPQNSPGTQRANARAPAPYKRDFEAKLRNFYRKLETKGYGQGPGKLKLIIRRDHLLEDAFNQIMGYSRKDLQRNKLYVTFVGEEGLDYSGPSREFFFLVSRELFNPYYGLFEYSANDTYTVQISPMSAFVDNHHEWFRFSGRILGLALIHQYLLDAFFTRPFYKALLRILCDLSDLEYLDEEFHQSLQWMKDNDIHDILDLTFTVNEEVFGQITERELKPGGANIPVTEKNKKEYIERMVKWRIERGVVQQTESLVRGFYEVVDARLVSVFDARELELVIAGTAEIDLSDWRNNTEYRGGYHDNHIVIRWFWAAVERFNNEQRLRLLQFVTGTSSIPYEGFASLRGSNGPRRFCVEKWGKITALPRAHTCFNRLDLPPYPSFSMLYEKLLTAVEETSTFGLE

SEQ ID NO: 841066 - protein, 180 aa, Homo sapiens
MVPVAYNDKIVAFLRQPNIFEILQERQPDLTRNHSLREKIQFIRTEGTPGLVRLSSDADLVMLLSLFEEEIMSYVPPHALLHPSYCQSPRGSPVSSPQNSPGTQRANARAPAPYKRDFEAKLRNFYRKLETKGYGQGPGKLKLIIRRDHLLEDAFNQIMGYSRKDLQRNKLYVTFVGEEG

SEQ ID NO: 841067 - protein, 1572 aa, Homo sapiens
MASSAREHLLFVRRRNPQMRYTLSPENLQSLAAQSSMPENMTLQRANSDTDLVTSESRSSLTASMYEYTLGQAQNLIIFWDIKEEVDPSDWIGLYHIDENSPANFWDSKNRGVTGTQKGQIVWRIEPGPYFMEPEIKICFKYYHGISGALRATTPCITVKNPAVMMGAEGMEGGASGNLHSRKLVSFTLSDLRAVGLKKGMFFNPDPYLKMSIQPGKKSSFPTCAHHGQERRSTIISNTTNPIWHREKYSFFALLTDVLEIEIKDKFAKSRPIIKRFLGKLTIPVQRLLERQAIGDQMLSYNLGRRLPADHVSGYLQFKVEVTSSVHEDASPEAVGTILGVNSVNGDLGSPSDDEDMPGSHHDSQVCSNGPVSEDSAADGTPKHSFRTSSTLEIDTEELTSTSSRTSPPRGRQDSLNDYLDAIEHNGHSRPGTATCSERSMGASPKLRSSFPTDTRLNAMLHIDSDEEDHEFQQDLGYPSSLEEEGGLIMFSRASRADDGSLTSQTKLEDNPVENEEASTHEAASFEDKPENLPELAESSLPAGPAPEEGEGGPEPQPSADQGSAELCGSQEVDQPTSGADTGTSDASGGSRRAVSETESLDQGSEPSQVSSETEPSDPARTESVSEASTRPEGESDLECADSSCNESVTTQLSSVDTRCSSLESARFPETPAFSSQEEEDGACAAEPTSSGPAEGSQESVCTAGSLPVVQVPSGEDEGPGAESATVPDQEELGEVWQRRGSLEGAAAAAESPPQEEGSAGEAQGTCEGATAQEEGATGGSQANGHQPLRSLPSVRQDVSRYQRVDEALPPNWEARIDSHGRIFYVDHVNRTTTWQRPTAPPAPQVLQRSNSIQQMEQLNRRYQSIRRTMTNERPEENTNAIDGAGEEADFHQASADFRRENILPHSTSRSRITLLLQSPPVKFLISPEFFTVLHSNPSAYRMFTNNTCLKHMITKVRRDTHHFERYQHNRDLVGFLNMFANKQLELPRGWEMKHDHQGKAFFVDHNSRTTTFIDPRLPLQSSRPTSALVHRQHLTRQRSHSAGEVGEDSRHAGPPVLPRPSSTFNTVSRPQYQDMVPVAYNDKIVAFLRQPNIFEILQERQPDLTRNHSLREKIQFIRTEGTPGLVRLSSDADLVMLLSLFEEEIMSYVPPHALLHPSYCQSPRGSPVSSPQNSPGTQRANARAPAPYKRDFEAKLRNFYRKLETKGYGQGPGKLKLIIRRDHLLEDAFNQIMGYSRKDLQRNKLYVTFVGEEGLDYSGPSREFFFLVSRELFNPYYGLFEYSANDTYTVQISPMSAFVDNHHEWFRFSGRILGLALIHQYLLDAFFTRPFYKALLRILCDLSDLEYLDEEFHQSLQWMKDNDIHDILDLTFTVNEEVFGQITERELKPGGANIPVTEKNKKEYIERMVKWRIERGVVQQTESLVRGFYEVVDARLVSVFDARELELVIAGTAEIDLSDWRNNTEYRGGYHDNHIVIRWFWAAVERFNNEQRLRLLQFVTGTSSIPYEGFASLRGSNGPRRFCVEKWGKITALPRAHTCFNRLDLPPYPSFSMLYEKLLTAVEETSTFGLE

SEQ ID NO: 841068 - protein, 108 aa, Homo sapiens
MIGLIGYHDNHIVIRWFWAAVERFNNEQRLRLLQFVTGTSSIPYEGFASLRGSNGPRRFCVEKWGKITALPRAHTCFNRLDLPPYPSFSMLYEKLLTAVEETSTFGLE

SEQ ID NO: 841069 - protein, 85 aa, Homo sapiens
LRASNGTPTLDTHFSRRMRTPRRTAVPPPRLHSPRRPPALHHPRAPPRHGPTPLFYPPPRTGLSPPKGNWAGPPPRWGIYKLLWP

SEQ ID NO: 841070 - protein, 85 aa, Homo sapiens; identical to SEQ ID NO: 841069

SEQ ID NO: 841071 - protein, 85 aa, Homo sapiens; identical to SEQ ID NO: 841069

SEQ ID NO: 841072 - protein, 111 aa, Homo sapiens
MDNAGKEREAVQLMAEAEKRVKASHSFLRGLFGGNTRIEEACEMYTRAANMFKMAKNWSAAGNAFCQAAKLHMQLQSKHDSATSFVDAGNAYKKADPQGKTARHVACYLCV

SEQ ID NO: 841073 - protein, 182 aa, Homo sapiens
MDNAGKEREAVQLMAEAEKRVKASHSFLRGLFGGKHKNRKKACGKLLLPKKAGKIIVPRMGLQKFGKVAGKGTTANFLVPRAKAKGFQQLPRLSRKAKTIWKFLAYQGFLVGIGLGKLALRKKGRNSPKKGALFQIGFKLGKANSEQFFTTMNIGRKGFTIWARPPSVQPTFIPLIGPEDFP

SEQ ID NO: 841074 - protein, 298 aa, Homo sapiens
MDNAGKEREAVQLMAEAEKRVKASHSFLRGLFGGNTRIEEACEMYTRAANMFKMAKNWSAAGNAFCQAAKLHMQLQSKHDSATSFVDAGNAYKKADPQEAINCLNAAIDIYTDMGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLALEKYEEMFPAFTDSRECKLLKKLLEAHEEQNSEAYTEAVKEFDSISRLDQWLTTMLLRIKKSIQGDGEGDGDLK

SEQ ID NO: 841075 - protein, 298 aa, Homo sapiens; identical to SEQ ID NO: 841074

SEQ ID NO: 841076 - protein, 298 aa, Homo sapiens; identical to SEQ ID NO: 841074

SEQ ID NO: 841077 - protein, 298 aa, Homo sapiens; identical to SEQ ID NO: 841074

SEQ ID NO: 841078 - protein, 131 aa, Homo sapiens
MTLLPALWMLEMLTKRQIPKGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLAP

SEQ ID NO: 841079 - protein, 298 aa, Homo sapiens; identical to SEQ ID NO: 841074

SEQ ID NO: 841080 - protein, 273 aa, Homo sapiens
MDNAGKEREAVQLMAEAEKRVKASHSFLRGLFGGNTRIEEACEMYTRAANMFKMAKNWSAAGNAFCQAAKLHMQLQSKHDSATSFVDAGNAYKKADPQEAINCLNAAIDIYTDMGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLALEKYEEMFPAFTDSRECKLLKKLLEAHEEQNSEAYTEAVSYAFGTWYII

SEQ ID NO: 841081 - protein, 294 aa, Homo sapiens
RGTEKSLYAISKPKEACLLGDAQQISQANLGVIEEANLRLSLVQASYWHLLLSTNLHTMVFAFWKVFLILSCLAGQVSVVQVTIPDGFVNVTVGSNVTLICIYTTTVASREQLSIQWSFFHKKEMEPISIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSRELTIQL

SEQ ID NO: 841082 - protein, 140 aa, Homo sapiens
MQNDVTGHVDVTHINVTQTRRWHHTDGDDVTHRHSDHTHHDDDTYRLWHLHHKHACPFTHTFYPILTKCHVPPGSSWYFPGEGRDIVPVKENFNPTTGILVIGNLTNFEQGYYQCTAINRLGNSSCEIDLTSSRELTIQL

SEQ ID NO: 841083 - protein, 299 aa, Homo sapiens
MLSAGLGLLMLVAVVEFLIGLIGNGSLVVWSFREWIRKFNWSSYNLIILGLAGCRFLLQWLIILDLSLFPLFQSSRWLRYLSIFWVLVSQASLWFATFLSVFYCKKITTFDRPAYLWLKQRAYNLSLWCLLGYFIINLLLTVQIGLTFYHPPQGNSSIRYPFESWQYLYAFQLNSGSYLPLVVFLVSSGMLIVSLYTHHKKMKVHSAGRRDVRAKAHITALKSLGCFLLLHLVYIMASPFSITSKTYPPDLTSVFIWETLMAAYPSLHSLILIMGIPRVKQTCQKILWKTVCARRCWGP

SEQ ID NO: 841084 - protein, 645 aa, Homo sapiens
QARPGGSSFCSERGEPGRAGARAGLGPLEGSGRTVSGAGPVGRGAGAAMAEGSAVSDPQHAARLLRALSSFREESRFCDAHLVLDGEEIPVQKNILAAASPYIRTKLNYNPPKDDGSTYKIELEGISVMVMREILDYIFSGQIRLNEDTIQDVVQAADLLLLTDLKTLCCEFLEGCIAAENCIGIRDFALHYCLHHVHYLATEYLETHFRDVSSTEEFLELSPQKLKEVISLEKLNVGNERYVFEAVIRWIAHDTEIRKVHMKDVMSALWVSGLDSSYLREQMLNEPLVREIVKECSNIPLSQPQQGEAMLANFKPRGYSECIVTVGGEERVSRKPTAAMRCMCPLYDPNRQLWIELAPLSMPRINHGVLSAEGFLFVFGGQDENKQTLSSGEKYDPDANTWTALPPMNEARHNFGIVEIDGMLYILGGEDGEKELISMECYDIYSKTWTKQPDLTMVRKIGCYAAMKKKIYAMGGGSYGKLFESVECYDPRTQQWTAICPLKERRFGAVACGVAMELYVFGGVRSREDAQGSEMVTCKSEFYHDEFKRWIYLNDQNLCIPASSSFVYGAVPIGASIYVIGDLDTGTNYDYVREFKRSTGTWHHTKPLLPSDLRRTGCAALRIANCKLFRLQLQQGLFRIRVHSP

SEQ ID NO: 841085 - protein, 576 aa, Homo sapiens
QARPGGSSFCSERGEPGRAGARAGLGPLEGSGRTVSGAGPVGRGAGAAMAEGSAVSDPQHAARLLRALSSFREESRFCDAHLVLDGEEIPVQKNILAAASPYIRTKLNYNPPKDDGSTYKIELEGISVMVMREILDYIFSGQIRLNEDTIQDVVQAADLLLLTDLKTLCCEFLEGCIAAENCIGIRDFALHYCLHHVHYLATEYLETHFRDVSSTEEFLELSPQKLKEVISLEKLNVGNERYVFEAVIRWIAHDTEIRKVHMKDVMSALWVSGLDSSYLREQMLNEPLVREIVKECSNIPLSQPQQGEAMLANFKPRGYSECIVTVGGEERVSRKPTAAMRCMCPLYDPNRQLWIELAPLSMPRINHGVLSAEGFLFVFGGQDENKQTLSSGEKYDPDANTWTALPPMNEARHNFGIVEIDGMLYILGGEDGEKELISMECYDIYSKTWTKQPDLTMVRKIGCYAAMKKKIYAMGGGSYGKLFESVECYDPRTQQWTAICPLKERRFGAVACGVAMELYVFGGVRSREDAQGSEMVTCKSEFYHDEFKRIYLLFFSFQSAQVVVVCPEFTADTWSN

SEQ ID NO: 841086 - protein, 101 aa, Homo sapiens
MLLSRACLNGSRTSSPCLNHHDQKGQASSTQQCTPKTLSTSQDPHGETAVINPLAINESLTTAILNPRVGPISLPATVVTRLTHVNRSRRKECSRSLLHPS

SEQ ID NO: 841087 - protein, 49 aa, Homo sapiens
MPDAGDAGTSCGTACYCLELVSMDLELHRPLCAVHLLCAVQLSTSSVLS

SEQ ID NO: 841088 - protein, 48 aa, Homo sapiens
MPDAGDAGTSCGTACYCLELVSMDLELHRPIRLSNGGSWRFPYRQLPL

SEQ ID NO: 841089 - protein, 46 aa, Homo sapiens
WFKDEIIGIAVGIGINTTDMMDMDEAFQLSNKKSRDTETWVPNKTS

SEQ ID NO: 841090 - protein, 337 aa, Homo sapiens
MEKSWMLWNFVERWLIALASWSWALCRISLLPLIVTFHLYGGIILLLLIFISIAGILYKFQDVLLYFPEQPSSSRLYVPMPTGIPHENIFIRTKDGIRLNLILIRYTGDNSPYSPTIIYFHGNAGNIGHRLPNALLMLVNLKVNLLLVDYRGYGKSEGEASEEGLYLDSEAVLDYVMTRPDLDKTKIFLFGRSLGGAVAIHLASENSHRISAIMVENTFLSIPHMASTLFSFFPMRYLPLWCYKNKFLSYRKISQCRMPSLFISGLSDQLIPPVMMKQLYELSPSRTKRLAIFPDGTHNDTWQCQGYFTALEQFIKEVVKSHSPEEMAKTSSNVTII

SEQ ID NO: 841091 - protein, 337 aa, Homo sapiens; identical to SEQ ID NO: 841090

SEQ ID NO: 841092 - protein, 337 aa, Homo sapiens; identical to SEQ ID NO: 841090

SEQ ID NO: 841093 - protein, 337 aa, Homo sapiens; identical to SEQ ID NO: 841090

SEQ ID NO: 841094 - protein, 337 aa, Homo sapiens; identical to SEQ ID NO: 841090

SEQ ID NO: 841095 - protein, 52 aa, Homo sapiens
MILRLPKPAVQWRGTRLCTRACLQTNELKGGLEGTLTTLQIERRKNSPVLQV

SEQ ID NO: 841096 - protein, 266 aa, Homo sapiens
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGMLSVSPH

SEQ ID NO: 841097 - protein, 396 aa, Homo sapiens
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGRLHRNREDYVERSAEFADGLLSKALKDIQSGALDINKAGILYGIPQKTLLLHLEALPAGKPASFKNKTRDFHDSYSYKDSKETCAVLQKVALWARAQAERTEKSKLNLLETSEIKFPTASTYLHQLTLQKMVTQFKE

SEQ ID NO: 841098 - protein, 231 aa, Homo sapiens
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQACYK

SEQ ID NO: 841099 - protein, 318 aa, Homo sapiens
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGMLQVKTDEKLNVSDENTASCPLSPIKMCLNRPIEWNLNLTTASLTSCTVHNQNLKSEEK

SEQ ID NO: 841100 - protein, 234 aa, Homo sapiens
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKGDGVLDLSTKKTSIKSEESSICDPSSENSVAGMLQVKTDEKLNVSDENTASCPLSPIKMCLNRPIEWNLNLTTASLTSCTVHNQNLKSEEK

SEQ ID NO: 841101 - protein, 66 aa, Homo sapiens
AGGAHTDPSSANTHSSGGHVHRPELRANTYSSRGHVHRPELSKHSLQPGTHAQTGAQSKHLLQPGT

SEQ ID NO: 841102 - protein, 793 aa, Homo sapiens
GRGGGGRGPGAAGRAPGPGPAPAAAAEPAGTPRSAATAQMAQTLQMEIPNFGNSILECLNEQRLQGLYCDVSVVVKGHAFKAHRAVLAASSSYFRDLFNNSRSAVVELPAAVQPQSFQQILSFCYTGRLSMNVGDQFLLMYTAGFLQIQEIMEKGTEFFLKVSSPSCDSQGLHAEEAPSSEPQSPVAQTSGWPACSTPLPLVSRVKTEQQESDSVQCMPVAKRLWDSGQKEAGGGGNGSRKMAKFSTPDLAANRPHQPPPPQQAPVVAAAQPAVAAGAGQPAGGVAAAGGVVSGPSTSERTSPGTSSAYTSDSPGSYHNEEDEEEDGGEEGMDEQYRQICNMYTMYSMMNVGQTAEKVEALPEQVAPESRNRIRVRQDLASLPAELINQIGNRCHPKLYDEGDPSEKLELVTGTNVYITRAQLMNCHVSAGTRHKVLLRRLLASFFDRNTLANSCGTGIRSSTNDPRRKPLDSRVLHAVKYYCQNFAPNFKESEMNAIAADMCTNARRVVRKSWMPKVKVLKAEDDAYTTFISETGKIEPDMMGVEHGFETASHEGEAGPSLKPCSNPPSLPRGHTLPLPTHTHTCHLGHELLSVPPQDPRWVLHVPGPLPLLSYPLSPPRAGPGEDRRAGGVRSVLPSLTHTRAVGEFWLPNLTPSRHLHTHQAHQGRGLAWGSWEGPSPGPRPPRGSLQPPPLTAAPWDLRGAPGVLRTPPTSSQCFHVSKSAFLSPSSIPAPGGWGRRGRGDYPFYSWGNRLREIAQPTSGGRQWRAWCPFSSSASVAPFGPLGPQRGRS

SEQ ID NO: 841103 - protein, 95 aa, Homo sapiens
RLSVSCGQTVSEDRMRGSQCFHVSKSAFLSPSSIPAPGGWGRRGRGDYPFYSWGNRLREIAQPTSGGRQWRAWCPFSSSASVAPFGPLGPQRGRS

SEQ ID NO: 841104 - protein, 489 aa, Homo sapiens
GRGGGGRGPGAAGRAPGPGPAPAAAAEPAGTPRSAATAQMAQTLQMEIPNFGNSILECLNEQRLQGLYCDVSVVVKGHAFKAHRAVLAASSSYFRDLFNNSRSAVVELPAAVQPQSFQQILSFCYTGRLSMNVGDQFLLMYTAGFLQIQEIMEKGTEFFLKVSSPSCDSQGLHAEEAPSSEPQSPVAQTSGWPACSTPLPLVSRVKTEQQESDSVQCMPVAKRLWDSGQKEAGGGGNGSRKMAKFSTPDLAANRPHQPPPPQQAPVVAAAQPAVAAGAGQPAGGVAAAGGVVSGPSTSERTSPGTSSAYTSDSPGSYHNEEDEEEDGGEEGMDEQYRQICNMYTMYSMMNVGQTAEKVEALPEQVAPESRNRIRVRQDLASLPAELINQIGNRCHPKLYDEGDPSEKLELVTGTNVYITRAQLMNCHVSAGTRHKVLLRRLLASFFDRAPDKRSPPAAKLKRLFHGLQNPTTRLQTRPQLVHTPACTAG

SEQ ID NO: 841105 - protein, 793 aa, Homo sapiens; identical to SEQ ID NO: 841102

SEQ ID NO: 841106 - protein, 90 aa, Homo sapiens
SMSPAPRNTLANSCGTGIRSSTNDPRRKPLDSRVLHAVKCECWPSWTRRGPGARRLTFFPSLGSQRGLEFSVEKHSGAHSSLAGKPAVIA

SEQ ID NO: 841107 - protein, 81 aa, Homo sapiens
QGVLGIKVKIMLPWDPTGKTGPKKPLPDHVSIVEPKDEILHTTPSQNRRVGSQNRLPSPSQSPQRNRVSLAAVFWSLDVVL

SEQ ID NO: 841108 - protein, 81 aa, Homo sapiens; identical to SEQ ID NO: 841107

SEQ ID NO: 841109 - protein, 81 aa, Homo sapiens; identical to SEQ ID NO: 841107

SEQ ID NO: 841110 - protein, 77 aa, Homo sapiens
SLAGKGILGNAIKWNFTKFLIDKNGCVVRGALWDYRHEPLCLVSTEVLHLDEVQFIFYFVACAFGVLSKNYFPNSVS

SEQ ID NO: 841111 - protein, 172 aa, Homo sapiens
RGKDHVCFAENPDTIKDSSFGLQHSLNSGQSLESVTLKGRAPRKQMSLLNSSEFQPQIRTVAKSHSDSCILSSNNLPTKDLLSALLEQGNKLRNAMVISAMKSSPETSMLLDQVHPPINEDSLRASTQIRAFSRNRFKDHIEDHLLPSTENTFWRHDTKADTRAIQLLLGQC

SEQ ID NO: 841112 - protein, 213 aa, Homo sapiens
SIHPFVSYLSIIHSSIYPSSIHPLSIQPLCISSFIHYLSFHPSSIIFPSTIYPFIHLSIIHPSFIHHSSAIIPPSIHYPSSTHPFIPPSAHYPSTIHPSIIRHPHIHSSLHLPIIHQPSIHPLYISALSIYSLSISSSIHHLSIHYPYTYLSSIHSFIYPSSINYPSIHPSIYPSSIDCLSSFLVSDFHPSSFHVSHILITQPSSCASIYSLI

SEQ ID NO: 841113 - protein, 65 aa, Homo sapiens
MQTSSQLVEWEVKSKLITLQNTPNTQELMVPGIAARWGYKNSAGSLLRKHLSSVFSFILQQLKPC

SEQ ID NO: 841114 - protein, 65 aa, Homo sapiens; identical to SEQ ID NO: 841113

SEQ ID NO: 841115 - protein, 65 aa, Homo sapiens; identical to SEQ ID NO: 841113

SEQ ID NO: 841116 - protein, 65 aa, Homo sapiens; identical to SEQ ID NO: 841113

SEQ ID NO: 841117 - protein, 63 aa, Homo sapiens
MLEVPEEEDFLYPSVMELNHISHTVTCDERHGRHSKSAEPRAMSMSGRRRLPKANCVGCALKD

SEQ ID NO: 841118 - protein, 726 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841119 - protein, 67 aa, Homo sapiens
LLMDPFNCGLRRKQEQEAAKLAKMKIPPSEMFLSETDKYSKFDENVSMVCPHMTWRAKSSAKGKPRS

SEQ ID NO: 841120 - protein, 736 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSGLLAVLCPPTARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841121 - protein, 809 aa, Homo sapiens
MADSSGQQAPDYRSILSISDEAARAQALNEHLSTRSYVQGYSLSQADVDAFRQLSAPPADPQLFHVARWFRHIEALLGSPCGKGQPCRLQASKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841122 - protein, 662 aa, Homo sapiens
MGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841123 - protein, 716 aa, Homo sapiens
MQTPPLQQPHQEQVFLAFLVIVIPSFLTKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841124 - protein, 687 aa, Homo sapiens
MHSCSSNTCCWRLSYTYRLVWKCLFFHCFRSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841125 - protein, 499 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKKQQSWPR

SEQ ID NO: 841126 - protein, 726 aa, Homo sapiens; identical to SEQ ID NO: 841118

SEQ ID NO: 841127 - protein, 683 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEVMHFVWG

SEQ ID NO: 841128 - protein, 661 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEGK

SEQ ID NO: 841129 - protein, 547 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDFLNHCGLVAAVCLSDNVPALLSCLQSPLGPKLRVVFM

SEQ ID NO: 841130 - protein, 461 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSAGSGGGPQPGGTWVSTNRGASKEGEEEEKKQARGTG

SEQ ID NO: 841131 - protein, 348 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGEEGMPESMWALPPGPAWVVLTLQATGAALSPPLRLLGTVLFHLKEF

SEQ ID NO: 841132 - protein, 213 aa, Homo sapiens
RRGARLPGRRLHQILGSVCSRSCGSGIPSHGRFLRAAGQRPACAAPVVPSCWDPAMQTPPLQQPHQEQVFLAFLVIVIPSFLTKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEKPRS

SEQ ID NO: 841133 - protein, 128 aa, Homo sapiens
MADSSGQQAPDYRSILSISDEAARAQALNEHLSTRSYVQGYSLSQADVDAFRQLSAPPADPQLFHVARWFRHIEALLGSPCGKGQPCRLQASKGRRVQPQWSPPAGTQPCRLHLYNSLTRNKCFLHFL

SEQ ID NO: 841134 - protein, 690 aa, Homo sapiens
RVSPLIAEQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841135 - protein, 683 aa, Homo sapiens; identical to SEQ ID NO: 841127

SEQ ID NO: 841136 - protein, 771 aa, Homo sapiens
RRGARLPGRRLHQILGSVCSRSCGSGIPSHGRFLRAAGQRPACAAPVVPSCWDPAMQTPPLQQPHQEQVFLAFLVIVIPSFLTKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841137 - protein, 686 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEHSESEGLEAS

SEQ ID NO: 841138 - protein, 652 aa, Homo sapiens
PRVNRHRKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841139 - protein, 484 aa, Homo sapiens
HHHPGDGLVILVDRKAIFCLKGIVLLILGRKTELEGKEHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841140 - protein, 341 aa, Homo sapiens
RPVPCGDAQRSPAPLSPALPCPALPCPAPGARPPRRIHVQTRQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841141 - protein, 676 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRADGSKMRQSSSHQGSGHPED

SEQ ID NO: 841142 - protein, 672 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKWRRKGDMEKEGQTERLADACTPHWVPSAVMPT

SEQ ID NO: 841143 - protein, 182 aa, Homo sapiens
TPSTSCTPLYAEIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 841144 - protein, 188 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEKPRS

SEQ ID NO: 841145 - protein, 147 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDAQEKLYKEYLQMAQNGSFQ

SEQ ID NO: 841146 - protein, 58 aa, Homo sapiens
GFPHSHAPRAFHPSIKLSNVKSCISQKSSCLLNGGNPGVKRQLFPLVVFLMPSKIPST

SEQ ID NO: 841147 - protein, 74 aa, Homo sapiens
PSLAVGSWREKKGGFPRLRETASPWATPASCSLPGDQVVATGVPRFPPLGSRAATRTKGDVRGASQQSWDAGST

SEQ ID NO: 841148 - protein, 379 aa, Homo sapiens
AGPSNGSFCSPGSEPPGAARGLAAPRPRCPPGVPLLRAPAAGCQLFGAPSRTQRRERARDKLELRPPRPSPAPLPLPPRGRAPTMLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 841149 - protein, 301 aa, Homo sapiens
ARSSPPSASDDLDETIQPCHSHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 841150 - protein, 344 aa, Homo sapiens
AVPQQRLILLPRVGAPRSCARACSASPALSSRCPASPRPSRRLPAFRGPESHPAKRAGPGQARTPAASPFPGSVFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 841151 - protein, 367 aa, Homo sapiens
AVPQQRLILLPRVGAPRSCARACSASPALSSRCPASPRPSRRLPAFRGPESHPAKRAGPGQARTPAASPFPGSAPSAPSGSRAHDAAGPWLAAAALPRLALLPGLGARALPLWPARLLLQAQQLQAHPGQPAAVPRHRIPEHAAAQPAGPRDHEGGAECHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 841152 - protein, 322 aa, Homo sapiens
AGPSNGSFCSPGSEPPGAARGLAAPRPRCPPGVPLLRAPAAGCQLFGAPSRTQRRERARDKLELRPPRPSPAPLPLPPRGRAPTMLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDSLQCTCEEMNDINAPYLVMGQKQGGELVITSVKRWQKGQREFKRISRSIRKLQC

SEQ ID NO: 841153 - protein, 379 aa, Homo sapiens; identical to SEQ ID NO: 841148

SEQ ID NO: 841154 - protein, 322 aa, Homo sapiens; identical to SEQ ID NO: 841152

SEQ ID NO: 841155 - protein, 354 aa, Homo sapiens
AGPSNGSFCSPGSEPPGAARGLAAPRPRCPPGVPLLRAPAAGCQLFGAPSRTQRRERARDKLELRPPRPSPAPLPLPPRGRAPTMLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELQC

SEQ ID NO: 841156 - protein, 354 aa, Homo sapiens; identical to SEQ ID NO: 841155

SEQ ID NO: 841157 - protein, 206 aa, Homo sapiens
AGPSNGSFCSPGSEPPGAARGLAAPRPRCPPGVPLLRAPAAGCQLFGAPSRTQRRERARDKLELRPPRPSPAPLPLPPRGRAPTMLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQQPRRSTRPRI

SEQ ID NO: 841158 - protein, 56 aa, Homo sapiens
QTMPDVQRTNDLASAYFSGLSFVPARDFPLGTSSPPPPALLRFELWATLPTPSGFQ

SEQ ID NO: 841159 - protein, 680 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERVLFPPPSLVPFITVVAQATQGTPFSWATPLSSHHHPHRKGRQKSPFSWLSFPEAGTGWAIMRHMISSPPKSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPAASPPPEGPVLTFQSEKMKGMKELLVATKINSSAIKLQLTAQSQVQMKKQKVSTPSDYTLSFLKRQRKGL

SEQ ID NO: 841160 - protein, 801 aa, Homo sapiens
LGNKSYSSLGNKSCCFREGFLAEPMMRLPNTVPIPAPRNPSSSSEPLTQSQTNVTQGSSQLVGAEVLTLNHKEHRSHLPAREPRTTQPLGVYFRTSEFNILRSKLRAPNNFSPAPEFGNPRFLSFVSRVWDTELRPQSMSGHWGSSLGCLGRTPSGTGRPGIVGDKKALQSRLRGLTDKRGEAGRRPPPAAMGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPAASPPPEGPVLTFQSEKMKGMKELLVATKINSSAIKLQLTAQSQVQMKKQKVSTPSDYTLSFLKRQRKGL

SEQ ID NO: 841161 - protein, 834 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERVLFPPPSLVPFITVVAQATQGTPFSWATPLSSHHHPHRKGRQKSPFSWLSFPEAGTGWAIMRHMISSPPKSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQELRIPLLGPAACPFFPSISFQPPSSRTEAWLPRPIPFSIQSLGSKATITQEVGTLIKVSIFPSLPSPPNFFFLRTVSNLQCLTTIIQQWDFHPRPHAPLLILAFFLWADPDSIILQGGPHLLPQPLGAPSPARSLGLPPMVRPLQTLQRPHCSHSYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPAASPPPEGPVLTFQSEKMKGMKELLVATKINSSAIKLQLTAQSQVQMKKQKVSTPSDYTLSFLKRQRKGL

SEQ ID NO: 841162 - protein, 276 aa, Homo sapiens [sequence omitted]

SEQ ID NO: 841163 - protein, 278 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWVFLKGSSCAVTADGVGSRGVQNLMNGNDRVSLDGKMSVPYRLDARLDGIRVAREPTQG

SEQ ID NO: 841164 - protein, 83 aa, Homo sapiens
GGVSSRELVKKVSDVIWNSLSRSYFKDRAHIQSLFSFITGSPEVGILSMTHFFKTLHGLQNPFKNCKPCEVRQVLFSSLQLGN

SEQ ID NO: 841165 - protein, 610 aa, Homo sapiens; identical to SEQ ID NO: 776279

SEQ ID NO: 841166 - protein, 610 aa, Homo sapiens; identical to SEQ ID NO: 776279

SEQ ID NO: 841167 - protein, 610 aa, Homo sapiens; identical to SEQ ID NO: 776279

SEQ ID NO: 841168 - protein, 610 aa, Homo sapiens; identical to SEQ ID NO: 776279

SEQ ID NO: 841169 - protein, 795 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERVLFPPPSLVPFITVVAQATQGTPFSWATPLSSHHHPHRKGRQKSPFSWLSFPEAGTGWAIMRHMISSPPKSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQELRIPLLGPAACPFFPSISFQPPSSRTEAWLPRPIPFSIQSLGSKATITQEVGTLIKVSIFPSLPSPPNFFFLRTVSNLQCLTTIIQQWDFHPRPHAPLLILAFFLWADPDSIILHYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPAASPPPEGPVLTFQSEKMKGMKELLVATKINSSAIKLQLTAQSQVQMKKQKVSTPSDYTLSFLKRQRKGL

SEQ ID NO: 841170 - protein, 278 aa, Homo sapiens; identical to SEQ ID NO: 841163

SEQ ID NO: 841171 - protein, 215 aa, Homo sapiens
GLVRGWFSGKTNAWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 841172 - protein, 102 aa, Homo sapiens
MRWLDSLRPLLTGIASFNASGLISVSRPCMTMERVTERRIHSDGLLSQPSELRDAVLLVFANKQDLPNAMNAAEITDTLWARMSGAFTPAGARAKPGRRVPP

SEQ ID NO: 841173 - protein, 219 aa, Homo sapiens
KQIASQPGVNRTRRNKHWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 841174 - protein, 231 aa, Homo sapiens
PPLTRRAPRPEALTWPPSEPPSCGSKTNAWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 841175 - protein, 214 aa, Homo sapiens
GLRGEFDTRTNAWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 841176 - protein, 223 aa, Homo sapiens
TPHNTDDAECGPGSFSARATRWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 841177 - protein, 214 aa, Homo sapiens; identical to SEQ ID NO: 841175

SEQ ID NO: 841178 - protein, 214 aa, Homo sapiens; identical to SEQ ID NO: 841175

SEQ ID NO: 841179 - protein, 214 aa, Homo sapiens; identical to SEQ ID NO: 841175

SEQ ID NO: 841180 - protein, 164 aa, Homo sapiens
MRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 841181 - protein, 214 aa, Homo sapiens; identical to SEQ ID NO: 841175

SEQ ID NO: 841182 - protein, 141 aa, Homo sapiens
MSEYPPYGLNRCKSALSPGHISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 841183 - protein, 214 aa, Homo sapiens; identical to SEQ ID NO: 841175

SEQ ID NO: 841184 - protein, 214 aa, Homo sapiens; identical to SEQ ID NO: 841175

SEQ ID NO: 841185 - protein, 117 aa, Homo sapiens
GLRGEFDTRTNAWLGAAASEVSLASVLPPVHKHGEHLRQPHSRAFLAKKEMRILMVGLDAAGKTTILYKLKLGEIVTTIPTIGFNVETVEYKTTCATSGDGLYEGLDWLSNQLRNQK

SEQ ID NO: 841186 - protein, 214 aa, Homo sapiens; identical to SEQ ID NO: 841175

SEQ ID NO: 841187 - protein, 214 aa, Homo sapiens; identical to SEQ ID NO: 841175

SEQ ID NO: 841188 - protein, 214 aa, Homo sapiens; identical to SEQ ID NO: 841175

SEQ ID NO: 841189 - protein, 214 aa, Homo sapiens; identical to SEQ ID NO: 841175

SEQ ID NO: 841190 - protein, 221 aa, Homo sapiens
GLRGEFDTRTNAWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLPQPARVRFAHRKRQPLLFSFVF

SEQ ID NO: 841191 - protein, 166 aa, Homo sapiens
GLRGEFDTRTNAWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQTSPTP

SEQ ID NO: 841192 - protein, 105 aa, Homo sapiens
MCLSLCSHGSQGPGWEPTATPTKCRRPPLPTFKASLWERRAPSVPSVAVWPRSGSVVPQQLVLASDTLGQDVWGPHPSRSACKAGQAGSTLDPHKPLGSTPHLCV

SEQ ID NO: 841193 - protein, 215 aa, Homo sapiens; identical to SEQ ID NO: 841171

SEQ ID NO: 841194 - protein, 231 aa, Homo sapiens; identical to SEQ ID NO: 841174

SEQ ID NO: 841195 - protein, 116 aa, Homo sapiens
MRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQTSPTP

SEQ ID NO: 841196 - protein, 214 aa, Homo sapiens; identical to SEQ ID NO: 841175

SEQ ID NO: 841197 - protein, 214 aa, Homo sapiens; identical to SEQ ID NO: 841175

SEQ ID NO: 841198 - protein, 214 aa, Homo sapiens; identical to SEQ ID NO: 841175

SEQ ID NO: 841199 - protein, 214 aa, Homo sapiens; identical to SEQ ID NO: 841175

SEQ ID NO: 841200 - protein, 214 aa, Homo sapiens; identical to SEQ ID NO: 841175

SEQ ID NO: 841201 - protein, 214 aa, Homo sapiens; identical to SEQ ID NO: 841175

SEQ ID NO: 841202 - protein, 214 aa, Homo sapiens; identical to SEQ ID NO: 841175

SEQ ID NO: 841203 - protein, 263 aa, Homo sapiens
GLRGEFDTRTNAWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGPDLVLTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 841204 - protein, 259 aa, Homo sapiens
GLRGEFDTRTNAWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQVGARASLGNVRSQCGFRLVVGVTGGWWGPFLCPVDSPSHQPFLPPDLPNAMNAAEITDKLGLHSLRHRNWYIQATCATSGDGLYEGLDWLSNQLRNQK

SEQ ID NO: 841205 - protein, 192 aa, Homo sapiens
GLRGEFDTRTNAWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREEDLPNAMNAAEITDKLGLHSLRHRNWYIQATCATSGDGLYEGLDWLSNQLRNQK

SEQ ID NO: 841206 - protein, 214 aa, Homo sapiens; identical to SEQ ID NO: 841175

SEQ ID NO: 841207 - protein, 214 aa, Homo sapiens; identical to SEQ ID NO: 841175

SEQ ID NO: 841208 - protein, 214 aa, Homo sapiens; identical to SEQ ID NO: 841175

SEQ ID NO: 841209 - protein, 297 aa, Homo sapiens
GLRGEFDTRTNAWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDTVIIAIRIKSLNYLKKKKNNMPHTKNTKKNKDEDTPRTPSTHNSEHPSYEDIYSTEHDLTGTTKTIANKSQSEDHMSSQHGRGRKHNSTADQDGSSSHKRRDNEQNTRDGRQHDPRQRATTQT

SEQ ID NO: 841210 - protein, 172 aa, Homo sapiens
GLRGEFDTRTNAWLGAAASEVSLASVLPPVHKHGEHLRQPHSRAFLAKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQAIQRLRPFNAS

SEQ ID NO: 841211 - protein, 108 aa, Homo sapiens
MGGGRASGRQAWSCGPGVHPLGPSHPQRGPGVPKGTLVDVIVVAATILFVSGAFASVRPSRTLWGGGSEGPRGETEAQGSERACPAGYWMRLCPLTMLDLAAGGETEA

SEQ ID NO: 841212 - protein, 992 aa, Homo sapiens
RPPEGSPRLRRLRGGRAAAGAMLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKAKSRLKCHLLSHRAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEEQTPKASKRERRDEQILAQLLPLLHGNVNGSKVIIREFQEHCRRGLLSNHTGSPRSPSTTYLHTPTPSEDAAIPSKSRLKRLISENSVYEKRPDFRMCWYVHPQVLQSFQQEHLPVPCQWSYVTSVPSAPKEDSGSVPSTGPSQGTPISLKRKSAGSMCITQFMKKRRHDGQIGAEDMDGFQADTEEEEEEEGDCMIVDVPDAVEVQAPCGAASGAGGGVGVDTGKATLTASPLGAS

SEQ ID NO: 841213 - protein, 480 aa, Homo sapiens
MVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEEQTPKASKRERRDEQILAQLLPLLHGNVNGSKVIIREFQEHCRRGLLSNHTGSPRSPSTTYLHTPTPSEDAAIPSKSRLKRLISENSVYEKRPDFRMCWYVHPQVLQSFQQEHLPVPCQWSYVTSVPSAPKEDSGSVPSTGPSQGTPISLKRKSAGSMCITQFMKKRRHDGQIGAEDMDGFQADTEEEEEEEGDCMIVDVPDAVEVQAPCGAASGAGGGVGVDTGKATLTASPLGAS

SEQ ID NO: 841214 - protein, 743 aa, Homo sapiens
RPPEGSPRLRRLRGGRAAAGAMLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEADT

SEQ ID NO: 841215 - protein, 960 aa, Homo sapiens
RPPEGSPRLRRLRGGRAAAGAMLEELECGAPGARGAATARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEEQTPKASKRERRDEQILAQLLPLLHGNVNGSKVIIREFQEHCRRGLLSNHTGSPRSPSTTYLHTPTPSEDAAIPSKSRLKRLISENSVYEKRPDFRMCWYVHPQVLQSFQQEHLPVPCQWSYVTSVPSAPKEDSGSVPSTGPSQGTPISLKRKSAGSMCITQFMKKRRHDGQIGAEDMDGFQADTEEEEEEEGDCMIVDVPDAVEVQAPCGAASGAGGGVGVDTGKATLTASPLGAS

SEQ ID NO: 841216 - protein, 453 aa, Homo sapiens
RPPEGSPRLRRLRGGRAAAGAMLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALELNLRKKGKGWSWIQRS

SEQ ID NO: 841217 - protein, 600 aa, Homo sapiens
MKIGSDEEEEKKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEEQTPKASKRERRDEQILAQLLPLLHGNVNGSKVIIREFQEHCRRGLLSNHTGSPRSPSTTYLHTPTPSEDAAIPSKSRLKRLISENSVYEKRPDFRMCWYVHPQVLQSFQQEHLPVPCQWSYVTSVPSAPKEDSGSVPSTGPSQGTPISLKRKSAGSMCITQFMKKRRHDGQIGAEDMDGFQADTEEEEEEEGDCMIVDVPDAVEVQAPCGAASGAGGGVGVDTGKATLTASPLGAS

SEQ ID NO: 841218 - protein, 590 aa, Homo sapiens
RPPEGSPRLRRLRGGRAAAGAMLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKAKSRLKCHLLSHRAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGQRAKEEAKKKKEEEKELKEKERREKREKDEKENASPLGAS

SEQ ID NO: 841219 - protein, 140 aa, Homo sapiens
GKAALRQQGRARWISGALAKEEVQRPCSRLRGRSVPGWWGAGRVNLRAGEQVTSRRGTTPQPLPVPTVRWRVPPWGCCRPHEAAGWGLPPGSPEGPASSRPSLSCPAEVQAPCGAASGAGGGVGVDTGKATLTASPLGAS

SEQ ID NO: 841220 - protein, 977 aa, Homo sapiens
RPPEGSPRLRRLRGGRAAAGAMLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEEQTPKASKRERRDEQILAQLLPLLHGNVNGSKVIIREFQEHCRRGLLSNHTGSPRSPSTTYLHTPTPSEDAAIPSKSRLKRLISENSVYEKRPDFRMCWYVHPQVLQSFQQEHLPVPCQWSYVTSVPSAPKEDSGSVPSTGPSQGTPISLKRKSAGSMCITQFMKKRRHDGQIGAEDMDGFQADTEEEEEEEGDCMIVDVPDAVEVQAPCGAASGAGGGVGVDTGKATLTASPLGAS

SEQ ID NO: 841221 - protein, 977 aa, Homo sapiens; identical to SEQ ID NO: 841220

SEQ ID NO: 841222 - protein, 902 aa, Homo sapiens
RPPEGSPRLRRLRGGRAAAGAMLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEEQTPKASKRERRDEQILAQLLPLLHGNVNGSKVIIREFQEHCRRGLLSNHTGSPRSPSTTYLHTPTPSEDAAIPSKSRLKRLISENQFMKKRRHDGQIGAEDMDGFQADTEEEEEEEGDCMIVDVPDAVEVQAPCGAASGAGGGVGVDTGKATLTASPLGAS

SEQ ID NO: 841223 - protein, 900 aa, Homo sapiens
RPPEGSPRLRRLRGGRAAAGAMLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEEQTPKASKRERRDEQILAQLLPLLHGNVNGSKVIIREFQEHCRRGLLSNHTGSPRSPSTTYLHTPTPSEDAAIPSKSRLKRLISENSVYEKRPDFRMCWYVHPQVLQSFQQEHLPVPCQWSYVTSVPQPGHSHLAEEEVSGQHVHHPIHEEAQARRPDWC

SEQ ID NO: 841224 - protein, 904 aa, Homo sapiens [sequence omitted]

SEQ ID NO: 841225 - protein, 480 aa, Homo sapiens; identical to SEQ ID NO: 841213

SEQ ID NO: 841226 - protein, 356 aa, Homo sapiens
RPPEGSPRLRRLRGGRAAAGAMLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKEIRQRSTEKEPS

SEQ ID NO: 841227 - protein, 31 aa, Homo sapiens
MRSCCFFPVLAVTCLLALQSWHFYPQGQLGH

SEQ ID NO: 841228 - protein, 344 aa, Homo sapiens
MASGVGAAFEELPHDGTCDECEPDEAPGAEEVCRECGFCYCRRHAEAHRQKFLSHHLAEYVHGSQAWTPPADGEGAGKEEAEVKVEQEREIESEAGEESESEEESESEEESETEEESEDESDEESEEDSEEEMEDEQESEAEEDNQEEGESEAEGETEAESEFDPEIEMEAERVAKRKCPDHGLDLSTYCQEDRQLICVLCPVIGAHQGHQLSTLDEAFEELRSKDSGGLKAAMIELVERLKFKSSDPKVTRDQMKMFIQQEFKKVQKVIADEEQKALHLVDIQEAMATAHVTEILADIQSHMDRLMTQMAQAKEQLDTSNESAEPKAEGDEEGPSGASEEEDT

SEQ ID NO: 841229 - protein, 218 aa, Homo sapiens
MASRMLREERRESEAEEDNQEEGESEAEGETEAESEFDPEIEMEAERVAKRKCPDHGLDLSTYCQEDRQLICVLCPVIGAHQGHQLSTLDEAFEELRSKDSGGLKAAMIELVERLKFKSSDPKVTRDQMKMFIQQEFKKVQKVIADEEQKALHLVDIQEAMATAHVTEILADIQSHMDRLMTQMAQAKEQLDTSNESAEPKAEGDEEGPSGASEEEDT

SEQ ID NO: 841230 - protein, 128 aa, Homo sapiens
GIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTD

SEQ ID NO: 841231 - protein, 99 aa, Homo sapiens
WCAGVGVGVGVDVGVQVLVWVLVCGAGVGVGVGVGVQVLVWMLVWVLVCTYWCAGVGVDVGVDIGVQVLVWVLVWTLACRCWCGCWCAGVGVDIGVQVL

SEQ ID NO: 841232 - protein, 101 aa, Homo sapiens
MRRTLRPPAAPRSPGIRRLRRADGELCLGLPSRKTTGRGACISAVPPALRFFECVSKVEEEEADSWDGKSLHLGTQGQIWGWAPTVYFMQISRGKYGAGHP

SEQ ID NO: 841233 - protein, 131 aa, Homo sapiens
MPDVGRPAATQRCESTPEDQALGEVDAPMIVQISDISLQDYLAVTEKFAKYLPSPVAGGLMPAKAFRKAQCAIVERLNKSMIDARRNKGQEGHDVGIGPGLLGDINLPPGEPSEACGAPIHGPGDHPWGRR

SEQ ID NO: 841234 - protein, 587 aa, Homo sapiens
RPRPGLRGGRAPCEVTMEAGGLPLELWRMILAYLHLPDLGRCSLVCRAWYELILSLDSTRWRQLCLGCTECRHPNWPNQPDVEPESWREAFKQHYLASKTWTKNALDLESSICFSLFRRRRERRTLSVGPGREFDSLGSALAMASLYDRIVLFPGVYEEQGEIILKVPVEIVGQGKLGEVALLASIDQHCSTTRLCNLVFTPAWFSPIMYKTTSGHVQFDNCNFENGHIQVHGPGTCQVKFCTFKNTHIFLHNVPLCVLENCEFVGSENNSVTVEGHPSADKNWAYKYLLGLIKSSPTFLPTEDSDFLMSLDLESRDQAWSPKTCDIVIEGSQSPTSPASSSPKPGSKAGSQEAEVGSDGERVAQTPDSSDGGLSPSGEDEDEDQLMYRLSYQVQGPRPVLGGSFLGPPLPGASIQLPSCLVLNSLQQELQKDKEAMALANSVQGCLIRKCLFRDGKGGVFVCSHGRAKMEGNIFRNLTYAVRCIHNSKIIMLRNDIYRCRASGIFLRLEGGGLIAGNNIYHNAEAGVDIRKKSNPLILCNQIHHGLRSGIVVLGNGKGIIRNNQIFSNKEAGIYILYHGNPVVRCV

SEQ ID NO: 841235 - protein, 571 aa, Homo sapiens
MEAGGLPLELWRMILAYLHLPDLGRCSLVCRAWYELILSLDSTRWRQLCLGCTECRHPNWPNQPDVEPESWREAFKQHYLASKTWTKNALDLESSICFSLFRRRRERRTLSVGPGREFDSLGSALAMASLYDRIVLFPGVYEEQGEIILKVPVEIVGQGKLGEVALLASIDQHCSTTRLCNLVFTPAWFSPIMYKTTSGHVQFDNCNFENGHIQVHGPGTCQVKFCTFKNTHIFLHNVPLCVLENCEFVGSENNSVTVEGHPSADKNWAYKYLLGLIKSSPTFLPTEDSDFLMSLDLESRDQAWSPKTCDIVIEGSQSPTSPASSSPKPGSKAGSQEAEVGSDGERVAQTPDSSDGGLSPSGEDEDEDQLMYRLSYQVQGPRPVLGGSFLGPPLPGASIQLPSCLVLNSLQQELQKDKEAMALANSVQGCLIRKCLFRDGKGGVFVCSHGRAKMEGNIFRNLTYAVRCIHNSKIIMLRNDIYRCRASGIFLRLEGGGLIAGNNIYHNAEAGVDIRKKSNPLILCNQIHHGLRSGIVVLGNGKGIIRNNQIFSNKEAGIYILYHGNPVVRCV

SEQ ID NO: 841236 - protein, 44 aa, Homo sapiens
STVPARNLWIQHASPISEEKAKRTTSDNSPLESMREALSKTSLT

SEQ ID NO: 841237 - protein, 107 aa, Homo sapiens
RCKPLRPALDTSFIETWLNQEVGKGVYLGVRQFEDILIQEEEKLKKINGDRSSCGRRGSKEPAVMTENMGLKESQLRPLGRSRERRWGTRWISSRIQFLVRFLKFMA

SEQ ID NO: 841238 - protein, 526 aa, Homo sapiens
RSMFTSGLTESTQKEVRIVGVEAESMDLVLNYAYTSRVILTEANVQALFTAASIFQIPSIQDQCAKYMISHLDPQNSIGVFIFADHYGHQELGDRSKEYIRKKFLCVTKEQEFLQLTKDQLISILDSDDLNVDREEHVYESIIRWFEHEQNEREVHLPEIFAKCIRFPLMEDTFIEKIPPQFAQAIAKSCVEKGPSNTNGCTQRLGMTASEMIICFDAAHKHSGKKQTVPCLDIVTGRVFKLCKPPNDLREVGILVSPDNDIYIAGGYRPSSSEVSIDHKAENDFWMYDHSTNRWLSKPSLLRARIGCKLVYCCGKMYAIGGRVYEGDGRNSLKSVECYDSRENCWTTVCAMPVAMEFHNAVEYKEKIYVLQGEFFLFYEPQKDYWGFLTPMTVPRIQGLAAVYKDSIYYIAGTCGNHQRMFTVEAYDIELNKWTRKKDFPCDQSINPYLKLVLFQNKLHLFVRATQVTVEEHVFRTSRKNSLYQYDDIADQWMKVYETPDRLWDLGRHFECAVAKLYPQCLQKVL

SEQ ID NO: 841239 - protein, 526 aa, Homo sapiens; identical to SEQ ID NO: 841238

SEQ ID NO: 841240 - protein, 112 aa, Homo sapiens [sequence omitted]

SEQ ID NO: 841241 - protein, 177 aa, Homo sapiens
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEEQTYRKNVQQMMQCLIRKLAALSQYEEVLAKI

SEQ ID NO: 841242 - protein, 31 aa, Homo sapiens
MMLAVGRACPLSDPGPSLLCLGYSIFLSCRG

SEQ ID NO: 841243 - protein, 344 aa, Homo sapiens
MLSSFPHRKTWRKSKKTVKVTRSYPTFPSLNAWEEFRGLLPVDGEPNPGAGLGVEEGLLCRVVHSPEFNLFLDSVVFESNFIQVKRGRNWRDVYKASNTMALGVTSSVPCLPLPNILLMASVKWHQGQNQTWNRPSIAPNIFLKRILPLRFVELQVCDHYQRILQLRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLSFRSSRKVETNKNSSGKDSSREDSIPCTCDLRWRASFTYGEWERENPSGLQPLSLLSTLAASTGPQLAPPIGNSI

SEQ ID NO: 841244 - protein, 245 aa, Homo sapiens
MALGVTSSVPCLPLPNILLMASVKWHQGQNQTWNRPSIAPNIFLKRILPLRFVELQVCDHYQRILQLRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLSFRSSRKVETNKNSSGKDSSREDSIPCTCDLRWRASFTYGEWERENPSGLQPLSLLSTLAASTGPQLAPPIGNSI

SEQ ID NO: 841245 - protein, 262 aa, Homo sapiens
MVKRGRNWRDVYKASNTMALGVTSSVPCLPLPNILLMASVKWHQGQNQTWNRPSIAPNIFLKRILPLRFVELQVCDHYQRILQLRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLSFRSSRKVETNKNSSGKDSSREDSIPCTCDLRWRASFTYGEWERENPSGLQPLSLLSTLAASTGPQLAPPIGNSI

SEQ ID NO: 841246 - protein, 423 aa, Homo sapiens
TRLRSDRRRASASAAMIPPEQPQQQLQPPSPAPPNHVVTTIENLPAEGSGGGGSLSASSRAGVRQRIRKVLNREMLISVALGQVLSLLICGIGLTSKYLSEDFHANTPVFQSFLNYILLFLVYTTTLAVRQGEENLLAILRRRWWKYMILGLIDLEANYLVVKAYQYTTLTSIQLLDCFVIPVVILLSWFFLLIRYKAVHFIGIVVCILGMGCMVGADVLVGRHQGAGENKLVGDLLVLGGATLYGISNVWEEYIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVVDLPTTAQVEPSVTYTSLGQETEEEPHVRVA

SEQ ID NO: 841247 - protein, 2882 aa, Homo sapiens
ARGAASPPAPGRAWPRQTPGRDSRAPARWMLPAHRSRVRRLPKDRYPRIRHPDKMPKRAHWGALSVVLILLWGHPRVALACPHPCACYVPSEVHCTFRSLASVPAGIAKHVERINLGFNSIQALSETSFAGLTKLELLMIHGNEIPSIPDGALRDLSSLQVFKFSYNKLRVITGQTLQGLSNLMRLHIDHNKIEFIHPQAFNGLTSLRLLHLEGNLLHQLHPSTFSTFTFLDYFRLSTIRHLYLAENMVRTLPASMLRNMPLLENLYLQGNPWTCDCEMRWFLEWDAKSRGILKCKKDKAYEGGQLCAMCFSPKKLYKHEIHKLKDMTCLKPSIESPLRQNRSRSIEEEQEQEEDGGSQLILEKFQLPQWSISLNMTDEHGNMVNLVCDIKKPMDVYKIHLNQTDPPDIDINATVALDFECPMTRENYEKLWKLIAYYSEVPVKLHRELMLSKDPRVSYQYRQDADEEALYYTGVRAQILAEPEWVMQPSIDIQLNRRQSTAKKVLLSYYTQYSQTISTKDTRQARGRSWVMIEPSGAVQRDQTVLEGGPCQLSCNVKASESPSIFWVLPDGSILKAPMDDPDSKFSILSSGWLRIKSMEPSDSGLYQCIAQVRDEMDRMVYRVLVQSPSTQPAEKDTVTIGKNPGESVTLPCNALAIPEAHLSWILPNRRIINDLANTSHVYMLPNGTLSIPKVQVSDSGYYRCVAVNQQGADHFTVGITVTKKGSGLPSKRGRRPGAKALSRVREDIVEDEGGSGMGDEENTSRRLLHPKDQEVFLKTKDDAINGDKKAKKGRRKLKLWKHSEKEPETNVAEGRRVFESRRRINMANKQINPERWADILAKVRGKNLPKGTEVPPLIKTTSPPSLSLEVTPPFPAISPPSASPVQTVTSAEESSADVPLLGEEEHVLGTISSASMGLEHNHNGVILVEPEVTSTPLEEVVDDLSEKTEEITSTEGDLKGTAAPTLISEPYEPSPTLHTLDTVYEKPTHEETATEGWSAADVGSSPEPTSSEYEPPLDAVSLAESEPMQYFDPDLETKSQPDEDKMKEDTFAHLTPTPTIWVNDSSTSQLFEDSTIGEPGVPGQSHLQGLTDNIHLVKSSLSTQDTLLIKKGMKEMSQTLQGGNMLEGDPTHSRSSESEGQESKSITLPDSTLGIMSSMSPVKKPAETTVGTLLDKDTTTATTTPRQKVAPSSTMSTHPSRRRPNGRRRLRPNKFRHRHKQTPPTTFAPSETFSTQPTQAPDIKISSQVESSLVPTAWVDNTVNTPKQLEMEKNAEPTSKGTPRRKHGKRPNKHRYTPSTVSSRASGSKPSPSPENKHRNIVTPSSETILLPRTVSLKTEGPYDSLDYMTTTRKIYSSYPKVQETLPVTYKPTSDGKEIKDDVATNVDKHKSDILVTGESITNAIPTSRSLVSTMGEFKEESSPVGFPGTPTWNPSRTAQPGRLQTDIPVTTSGENLTDPPLLKELEDVDFTSEFLSSLTVSTPFHQEEAGSSTTLSSIKVEVASSQAETTTLDQDHLETTVAILLSETRPQNHTPTAARMKEPASSSPSTILMSLGQTTTTKPALPSPRISQASRDSKENVFLNYVGNPETEATPVNNEGTQHMSGPNELSTPSSDQDAFNLSTKLELEKQVFGSRSLPRGPDSQRQDGRVHASHQLTRVPAKPILPTATVRLPEMSTQSASRYFVTSQSPRHWTNKPEITTYPSGALPENKQFTTPRLSSTTIPLPLHMSKPSIPSKFTDRRTDQFNGYSKVFGNNNIPEARNPVGKPPSPRIPHYSNGRLPFFTNKTLSFPQLGVTRRPQIPTSPAPVMRERKVIPGSYNRIHSHSTFHLDFGPPAPPLLHTPQTTGSPSTNLQNIPMVSSTQSSISFITSSVQSSGSFHQSSSKFFAGGPPASKFWSLGEKPQILTKSPQTVSVTAETDTVFPCEATGKPKPFVTWTKVSTGALMTPNTRIQRFEVLKNGTLVIRKVQVQDRGQYMCTASNLHGLDRMVVLLSVTVQQPQILASHYQDVTVYLGDTIAMECLAKGTPAPQISWIFPDRRVWQTVSPVEGRITLHENRTLSIKEASFSDRGVYKCVASNAAGADSLAIRLHVAALPPVIHQEKLENISLPPGLSIHIHCTAKAAPLPSVRWVLGDGTQIRPSQFLHGNLFVFPNGTLYIRNLAPKDSGRYECVAANLVGSARRTVQLNVQRAAANARITGTSPRRTDVRYGGTLKLDCSASGDPWPRILWRLPSKRMIDALFSFDSRIKVFANGTLVVKSVTDKDAGDYLCVARNKVGDDYVVLKVDVVMKPAKIEHKEENDHKVFYGGDLKVDCVATGLPNPEISWSLPDGSLVNSFMQSDDSGGRTKRYVVFNNGTLYFNEVGMREEGDYTCFAENQVGKDEMRVRVKVVTAPATIRNKTYLAVQVPYGDVVTVACEAKGEPMPKVTWLSPTNKVIPTSSEKYQIYQDGTLLIQKAQRSDSGNYTCLVRNSAGEDRKTVWIHVNVQPPKINGNPNPITTVREIAAGGSRKLIDCKAEGIPTPRVLWAFPEGVVLPAPYYGNRITVHGNGSLDIRSLRKSDSVQLVCMARNEGGEARLILQLTVLEPMEKPIFHDPISEKITAMAGHTISLNCSAAGTPTPSLVWVLPNGTDLQSGQQLQRFYHKADGMLHISGLSSVDAGAYRCVARNAAGHTERLVSLKVGLKPEANKQYHNLVSIINGETLKLPCTPPGAGQGRFSWTLPNGMHLEGPQTLGRVSLLDNGTLTVREASVFDRGTYVCRMETEYGPSVTSIPVIVIAYPPRITSEPTPVIYTRPGNTVKLNCMAMGIPKADITWELPDKSHLKAGVQARLYGNRFLHPQGSLTIQHATQRDAGFYKCMAKNILGSDSKTTYIHVF

SEQ ID NO: 841248 - protein, 2847 aa, Homo sapiens
ARGAASPPAPGRAWPRQTPGRDSRAPARWMLPAHRSRVRRLPKDRYPRIRHPDKMPKRAHWGALSVVLILLWGHPRVALACPHPCACYVPSEVHCTFRSLASVPAGIAKHVERINLGFNSIQALSETSFAGLTKLELLMIHGNEIPSIPDGALRDLSSLQVFKFSYNKLRVITGQTLQGLSNLMRLHIDHNKIEFIHPQAFNGLTSLRLLHLEGNLLHQLHPSTFSTFTFLDYFRLSTIRHLYLAENMVRTLPASMLRNMPLLENLYLQGNPWTCDCEMRWFLEWDAKSRGILKCKKDKAYEGGQLCAMCFSPKKLYKHEIHKLKDMTCLKPSIESPLRQNRSRSIEEEQEQEEDGGSQLILEKFQLPQWSISLNMTDEHGNMVNLVCDIKKPMDVYKIHLNQTDPPDIDINATVALDFECPMTRENYEKLWKLIAYYSEVPVKLHRELMLSKDPRVSYQYRQDADEEALYYTGVRAQILAEPEWVMQPSIDIQLNRRQSTAKKVLLSYYTQYSQTISTKDTRQARGRSWVMIEPSGAVQRDQTVLEGGPCQLSCNVKASESPSIFWVLPDGSILKAPMDDPDSKFSILSSGWLRIKSMEPSDSGLYQCIAQVRDEMDRMVYRVLVQSPSTQPAEKDTVTIGKNPGESVTLPCNALAIPEAHLSWILPNRRIINDLANTSHVYMLPNGTLSIPKVQVSDSGYYRCVAVNQQGADHFTVGITVTKKGSGLPSKRGRRPGAKALSRVREDIVEDEGGSGMGDEENTSRRLLHPKDQEVFLKTKDDAINGDKKAKKGRRKLKLWKHSEKEPETNVAEGRRVFESRRRINMANKQINPERWADILAKVRGKNLPKGTEVPPLIKTTSPPSLSLEVTPPFPAISPPSASPVQTVTSAEESSADVPLLGEEEHVLGTISSASMGLEHNHNGVILVEPEVTSTPLEEVVDDLSEKTEEITSTEGDLKGTAAPTLISEPYEPSPTLHTLDTVYEKPTHEETATEGWSAADVGSSPEPTSSEYEPPLDAVSLAESEPMQYFDPDLETKSQPDEDKMKEDTFAHLTPTPTIWVNDSSTSQLFEDSTIGEPGVPGQSHLQGLTDNIHLVKSSLSTQDTLLIKKGMKEMSQTLQGGNMLEGDPTHSRSSESEGQESKSITLPDSTLGIMSSMSPVKKPAETTVGTLLDKDTTTATTTPRQKVAPSSTMSTHPSRRRPNGRRRLRPNKFRHRHKQTPPTTFAPSETFSTQPTQAPDIKISSQVESSLVPTAWVDNTVNTPKQLEMEKNAEPTSKGTPRRKHGKRPNKHRYTPSTVSSRASGSKPSPSPENKHRNIVTPSSETILLPRTVSLKTEGPYDSLDYMTTTRKIYSSYPKVQETLPVTYKPTSDGKEIKDDVATNVDKHKSDILVTGESITNAIPTSRSLVSTMGEFKEESSPVGFPGTPTWNPSRTAQPGRLQTDIPVTTSGENLTDPPLLKELEDVDFTSEFLSSLTVSTPFHQEEAGSSTTLSSIKVEVASSQAETTTLDQDHLETTVAILLSETRPQNHTPTAARMKEPASSSPSTILMSLGQTTTTKPALPSPRISQASRDSKENVFLNYVGNPETEATPVNNEGTQHMSGPNELSTPSSDQDAFNLSTKLELEKQVFGSRSLPRGPDSQRQDGRVHASHQLTRVPAKPILPTATVRLPEMSTQSASRYFVTSQSPRHWTNKPEITTYPSGALPENKQFTTPRLSSTTIPLPLHMSKPSIPSKFTDRRTDQFNGYSKVFGNNNIPEARNPVGKPPSPRIPHYSNGRLPFFTNKTLSFPQLGVTRRPQIPTSPAPVMRERKVIPGSYNRIHSHSTFHLDFGPPAPPLLHTPQTTGSPSTNLQNIPMVSSTQSSISFITSSVQSSGSFHQSSSKFFAGGPPASKFWSLGEKPQILTKSPQTVSVTAETDTVFPCEATGKPKPFVTWTKVSTGALMTPNTRIQRFEVLKNGTLVIRKVQVQDRGQYMCTASNLHGLDRMVVLLSVTVQQPQILASHYQDVTVYLGDTIAMECLAKGTPAPQISWIFPDRRVWQTVSPVEGRITLHENRTLSIKEASFSDRGVYKCVASNAAGADSLAIRLHVAALPPVIHQEKLENISLPPGLSIHIHCTAKAAPLPSVRWVLGDGTQIRPSQFLHGNLFVFPNGTLYIRNLAPKDSGRYECVAANLVGSARRTVQLNVQRAAANARITGTSPRRTDVRYGGTLKLDCSASGDPWPRILWRLPSKRMIDALFSFDSRIKVFANGTLVVKSVTDKDAGDYLCVARNKVGDDYVVLKVDVVMKPAKIEHKEENDHKVFYGGDLKVDCVATGLPNPEISWSLPDGSLVNSFMQSDDSGGRTKRYVVFNNGTLYFNEVGMREEGDYTCFAENQVGKDEMRVRVKVVTAPATIRNKTYLAVQVPYGDVVTVACEAKGEPMPKVTWLSPTNKVIPTSSEKYQIYQDGTLLIQKAQRSDSGNYTCLVRNSAGEDRKTVWIHVNVQPPKINGNPNPITTVREIAAGGSRKLIDCKAEGIPTPRVLWAFPEGVVLPAPYYGNRITVHGNGSLDIRSLRKSDSVQLVCMARNEGGEARLILQLTVLEPMEKPIFHDPDLQSGQQLQRFYHKADGMLHISGLSSVDAGAYRCVARNAAGHTERLVSLKVGLKPEANKQYHNLVSIINGETLKLPCTPPGAGQGRFSWTLPNGMHLEGPQTLGRVSLLDNGTLTVREASVFDRGTYVCRMETEYGPSVTSIPVIVIAYPPRITSEPTPVIYTRPGNTVKLNCMAMGIPKADITWELPDKSHLKAGVQARLYGNRFLHPQGSLTIQHATQRDAGFYKCMAKNILGSDSKTTYIHVF

SEQ ID NO: 841249 - protein, 166 aa, Homo sapiens
MHFCLLTDSFTYYFLSLVSQVTLFEYQQPYTQEHRGFTVEMGKEFKTTCLFLSITYFHLSHRKKKTHSYLGKAPRNPQRLSWICWALMLLWPAPLQIVRPAIPQRRNKICWPLFHPLLLPYAFFSWFHSFLWLCHLYAYCCQVCITIPSEYFLLHITLFYPDAYWT

SEQ ID NO: 841250 - protein, 222 aa, Homo sapiens
VQLEAQARLLGQRANGPSRREPGDYAAPCRSTFRLGGSTMKKVKKKRSEARRHRDSTSQHASSNSTSQQPSPESTPQQPSPESTPQHSSLETTSRQPAFQALPAPEIRRSSCCLLSPDANVKAAPQSRKAGPLIRAGPHSCSCATCPCSSACWRRLGLCHSRIFDVLLPRDWQMAPGRGLPNLLTFYRKSSRKPSSHRNACPPSPRNCGCGSGGSRSCLLHH

SEQ ID NO: 841251 - protein, 231 aa, Homo sapiens
VQLEAQARLLGQRANGPSRREPGDYAAPCRSTFRLGGSTMKKVKKKRSEARRHRDSTSQHASSNSTSQQPSPESTPQQPSPESTPQQPSPESTPQHSSLETTSRQPAFQALPAPEIRRSSCCLLSPDANVKAAPQSRKAGPLIRAGPHSCSCATCPCSSACWRRLGLCHSRIFDVLLPRDWQMAPGRGLPNLLTFYRKSSRKPSSHRNACPPSPRNCGCGSGGSRSCLLHH

SEQ ID NO: 841252 - protein, 222 aa, Homo sapiens; identical to SEQ ID NO: 841250

SEQ ID NO: 841253 - protein, 177 aa, Homo sapiens
VQLEAQARLLGQRANGPSRREPGDYAAPCRSTFRLGGSTMKKVKKKRSEARRHRDSTSQHASSNSTSQQPSPESTPQQPSPESTPQQPSPESTPQHSSLETTSRQPAFQALPAPEIRRSSCCLLSPDANVKAAPQSRKAENLQENPPVIVTRVLQALGTVAVALGALGAAYYITESL

SEQ ID NO: 841254 - protein, 222 aa, Homo sapiens; identical to SEQ ID NO: 841250

SEQ ID NO: 841255 - protein, 177 aa, Homo sapiens; identical to SEQ ID NO: 841253

SEQ ID NO: 841256 - protein, 41 aa, Homo sapiens
ATTVTSKTKVSGRYQDTRKGAGSRAGSKLGPGGQKKRQETK

SEQ ID NO: 841257 - protein, 582 aa, Homo sapiens
MSSSLGKEKDSKEKDPKVPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENKIKQLPAEIGELCNLITLDVAHNQLEHLPKEIGNCTQITNLDLQHNELLDLPDTIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 841258 - protein, 582 aa, Homo sapiens; identical to SEQ ID NO: 841257

SEQ ID NO: 841259 - protein, 564 aa, Homo sapiens
MSSSLGKEKDSKEKDPKVPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENDVAHNQLEHLPKEIGNCTQITNLDLQHNELLDLPDTIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 841260 - protein, 341 aa, Homo sapiens
GEWGRGGRGAAVGQRRFLGGGGRGGRRASEEDGGVGAPDGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 841261 - protein, 288 aa, Homo sapiens
MSSSLGKEKDSKEKDPKVPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENKIKQLPAEIGELCNLITLDVAHNQLEHLPKEIGNCTQITNLDLQHNELLDLPDTIGMRGERRY

SEQ ID NO: 841262 - protein, 292 aa, Homo sapiens
GEWGRGGRGAAVGQRRFLGGGGRGGRRASEEDGGVGAPDGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLGRTCIWKWTSPNLD

SEQ ID NO: 841263 - protein, 582 aa, Homo sapiens; identical to SEQ ID NO: 841257

SEQ ID NO: 841264 - protein, 582 aa, Homo sapiens; identical to SEQ ID NO: 841257

SEQ ID NO: 841265 - protein, 582 aa, Homo sapiens; identical to SEQ ID NO: 841257

SEQ ID NO: 841266 - protein, 199 aa, Homo sapiens
SSVGGLLVSVKSPPGDVHAARACAPGRHSGEGPPQGNLSPSCPAEAGHGCASTGRQVGVSGAGSSPPGPAPCVKCSAWVGTCFPLSLLQAAGGPTGSPNGFCPEPWAPDHASTLHGLNKSLRQGPRSGGAQRKPRAHTGEGVSGLSLTQPRLSSSLRISWHLLACVATQVGCARRLREKTLGEDYVSAFLPSTGPSWAH

SEQ ID NO: 841267 - protein, 68 aa, Homo sapiens
KNKKQTNKKTYFLGLLGTSSYPKGNARFIASFSFGISAKISLLALTLAISTISHAFKRIFSICLSIYQ

SEQ ID NO: 841268 - protein, 70 aa, Homo sapiens
LLAYTCKIWQLLFGYMLGNPIASGVARSGGTREISMAVPAVTSGWGQEWDSGVWEGPAKNLSEPSALEEL

SEQ ID NO: 841269 - protein, 116 aa, Homo sapiens
PLHLRALTSSSSSLLLTSSSQWYLRCSSRPPSCELLSLGLTPYSTPPEDWPTIFEGVPGLSLEKDMIKMKGMREEGREKQTNRQRERGRGKALPQANPASVVVYFPEFLPAAPLCA

SEQ ID NO: 841270 - protein, 634 aa, Homo sapiens
MDNAVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKENTENHSETPAAPALPPSAPPKPRPKPKPKKSPVPPKGATAGASHKGDEVPPIKKNTKAPGKQAPVPPPKPASRNTTREAAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 841271 - protein, 513 aa, Homo sapiens
FIIILRNDLILTCAVFFLKVLERKISTRQSREELIRRGVLKELPDQDGDVTVNFENSNGHMIPIGEESTREENVVKSEEGNGSVSEKTPPLEEQAEDKKAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 841272 - protein, 512 aa, Homo sapiens
AKSGRSVIGRGRNRQKKKENTENHSETPAAPALPPSAPPKPRPKPKPKKSPVPPKGATAGASHKGDEVPPIKKNTKAPGKQAPVPPPKPASRNTTREAAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 841273 - protein, 334 aa, Homo sapiens
CPSPFVRPSPFVCPSPFVCPSPFVCPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 841274 - protein, 565 aa, Homo sapiens
SSSRGRPLRVHISGSVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 841275 - protein, 565 aa, Homo sapiens; identical to SEQ ID NO: 841274

SEQ ID NO: 841276 - protein, 184 aa, Homo sapiens
SSSRGRPLRVHISGSVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKGKIKTNPYYLLQYIAQCLEPALRLQLVTLKPAV

SEQ ID NO: 841277 - protein, 634 aa, Homo sapiens; identical to SEQ ID NO: 841270

SEQ ID NO: 841278 - protein, 565 aa, Homo sapiens; identical to SEQ ID NO: 841274

SEQ ID NO: 841279 - protein, 512 aa, Homo sapiens
MGQTSVSTLSPQPGSVDGLDKASIANSDGPTAGSQTPPFKRKGKLSTIGKIFKPWKWRKKKTSDKFRETSAVLERKISTRQSREELIRRGVLKELPDQAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 841280 - protein, 565 aa, Homo sapiens; identical to SEQ ID NO: 841274

SEQ ID NO: 841281 - protein, 565 aa, Homo sapiens; identical to SEQ ID NO: 841274

SEQ ID NO: 841282 - protein, 1936 aa, Homo sapiens
MDRVGGGKGPGGSYYRVSSSAARSRKLCPGRVNRGLSAQSTAATATMGGKNKQRTKGNLRPSNSGRAAELLAKEQGTVPGFIGFGTSQSDLGYVPAIQGAEEIDSLVDSDFRMVLRKLSKKDVTTKLKAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSSESSAVISAFFECLRFIMQQNLGEEEIEQMLVNDQKSTQKTSVTKYVEISPTQQAVSSAADTSYVSSNSILTIYLEIVSDLTGLGLSPTRPLPTSDANRKPQAVLPGLLTNQLYIKIRDPMTPSWGLLNLLDCLTELRETIYQFTINDITKDTNEDMHTLIPFIDAVLKDPGLQHGQLFNHLAETLSSWEAKADTEKDEKTAHNLENVLIHFWERLSEICVAKISEPEADVESVLGVSNLLQVLQKPKSSLKSSKKKNGKVRFADEILESNKENEKCVSSEGEKIEGWELTTEPSLTHNSSGLLSPLRKKPLEDLVCKLADISINYVNERKSEQHLRFLSTLLDSFSSSRVFKMLLGDEKQSIVQAKPLEIAKLVQKNPAVQFLYQKLIGWLNEDQRKDFGFLVDILYSALRCCDNDMERKKVLDDLTKVDLKWNSLLKIIEKACPSSDKHALVTPWLKGDILGEKLVNLADCLCNEDLESRVSSESHFSERWTLLSLVLSQHVKNDYLIGDVYVERIIVRLHETLFKTKKLSEAESSDSSVSFICDVAYNYFSSAKGCLLMPSSEDLLLTLFQLCAQSKEKTHLPDFLICKLKNTWLSGVNLLVHQTDSSYKESTFLHLSALWLKNQVQASSLDINSLQVLLSAVDDLLNTLLESEDSYLMGVYIGSVMPNDSEWEKMRQSLPMQWLHRPLLEGRLSLNYECFKTDFKEQDIKTLPSHLCTSALLSKMVLIALRKETVLENNELEKIIAELLYSLQWCEELDNPPIFLIGFCEILQKMNITYDNLRVLGNTSGLLQLLFNRSREHGTLWSLIIAKLILSRSISSDEVKPHYKRKESFFPLTEGNLHTIQSLCPFLSKEEKKEFSAQCIPALLGWTKKDLCSTNGGFGHLAIFNSCLQTKSIDDGELLHGILKIIISWKKEHEDIFLFSCNLSEASPEVLGVNIEIIRFLSLFLKYCSSPLAESEWDFIMCSMLAWLETTSENQALYSIPLVQLFACVSCDLACDLSAFFDSTTLDTIGNLPVNLISEWKEFFSQGIHSLLLPILVTVTGENKDVSETSFQNAMLKPMCETLTYISKEQLLSHKLPARLVADQKTNLPEYLQTLLNTLAPLLLFRARPVQIAVYHMLYKLMPELPQYDQDNLKSYGDEEEEPALSPPAALMSLLSIQEDLLENVLGCIPVGQIVTIKPLSEDFCYVLGYLLTWKLILTFFKAASSQLRALYSMYLRKTKSLNKLLYHLFRLMPENPTYAETAVEVPNKDPKTFFTEELQLSIRETTMLPYHIPHLACSVYHMTLKDLPAMVRLWWNSSEKRVFNIVDRFTSKYVSSVLSFQEISSVQTSTQLFNGMTVKARATTREVMATYTIEDIVIELIIQLPSNYPLGSIIVESGKRVGVAVQQWRNWMLQLSTYLTHQNGSIMEGLALWKNNVDKRFEGVEDCMICFSVIHGFNYSLPKKACRTCKKKFHSACLYKWFTSSNKSTCPLCRETFF

SEQ ID NO: 841283 - protein, 1812 aa, Homo sapiens [sequence omitted]

SEQ ID NO: 841284 - protein, 1181 aa, Homo sapiens
MDRVGGGKGPGGSYYRVSSSAARSRKLCPGRVNRGLSAQSTAATATMGGKNKQRTKGNLRPSNSGRAAELLAKEQGTVPGFIGFGTSQSDLGYVPAIQGAEEIDSLVDSDFRMVLRKLSKKDVTTKLKAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSSESSAVISAFFECLRFIMQQNLGEEEIEQMLVNDQLIPFIDAVLKDPGLQHGQLFNHLAETLSSWEAKADTEKDEKTAHNLENVLIHFWERLSEICVAKISEPEADVESVLGVSNLLQVLQKPKSSLKSSKKKNGKVRFADEILESNKENEKCVSSEGEKIEGWELTTEPSLTHNSSGLLSPLRKKPLEDLVCKLADISINYVNERKSEQHLRFLSTLLDSFSSSRVFKMLLGDEKQSIVQAKPLEIAKLVQKNPAVQFLYQKLIGWLNEDQRKDFGFLVDILYSALRCCDNDMERKKVLDDLTKVDLKWNSLLKIIEKACPSSDKHALVTPWLKGDILGEKLVNLADCLCNEDLESRVSSESHFSERWTLLSLVLSQHVKNDYLIGDVYVERIIVRLHETLFKTKKLSEAESSDSSVSFICDVAYNYFSSAKGCLLMPSSEDLLLTLFQLCAQSKEKTHLPDFLICKLKNTWLSGVNLLVHQTDSSYKESTFLHLSALWLKNQVQASSLDINSLQVLLSAVDDLLNTLLESEDSYLMGVYIGSVMPNDSEWEKMRQSLPMQWLHRPLLEGRLSLNYECFKTDFKEQDIKTLPSHLCTSALLSKMVLIALRKETVLENNELEKIIAELLYSLQWCEELDNPPIFLIGFCEILQKMNITYDNLRVLGNTSGLLQLLFNRSREHGTLWYVIIIKPPFENGCAPKVSFASLTRGELQGQPWPRPKLCSEKINICPT

SEQ ID NO: 841285 - protein, 519 aa, Homo sapiens [sequence omitted]

SEQ ID NO: 841286 - protein, 1812 aa, Homo sapiens [sequence omitted]

SEQ ID NO: 841287 - protein, 1812 aa, Homo sapiens [sequence omitted]

SEQ ID NO: 841288 - protein, 1556 aa, Homo sapiens
MDRVGGGKGPGGSYYRVSSSAARSRKLCPGRVNRGLSAQSTAATATMGGKNKQRTKGNLRPSNSGRAAELLAKEQGTVPGFIGFGTSQSDLGYVPAIQGAEEIDSLVDSDFRMVLRKLSKKDVTTKLKAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSSESSAVISAFFECLRFIMQQNLGEEEIEQMLVNDQLIPFIDAVLKDPGLQHGQLFNHLAETLSSWEAKADTEKDEKTAHNLENVLIHFWERLSEICVAKISEPEADVESVLGVSNLLQVLQKPKSSLKSSKKKNGKVRFADEILESNKENEKCVSSEGEKIEGWELTTEPSLTHNSSGLLSPLRKKPLEDLVCKLADISINYVNERKSEQHLRFLSTLLDSFSSSRVFKMLLGDEKQSIVQAKPLEIAKLVQKNPAVQFLYQKLIGWLNEDQRKDFGFLVDILYSALRCCDNDMERKKVLDDLTKVDLKWNSLLKIIEKACPSSDKHALVTPWLKGDILGEKLVNLADCLCNEDLESRVSSESHFSERWTLLSLVLSQHVKNDYLIGDVYVERIIVRLHETLFKTKKLSEAESSDSSVSFICDVAYNYFSSAKGCLLMPSSEDLLLTLFQLCAQSKEKTHLPDFLICKLKNTWLSGVNLLVHQTDSSYKESTFLHLSALWLKNQVQASSLDINSLQVLLSAVDDLLNTLLESEDSYLMGVYIGSVMPNDSEWEKMRQSLPMQWLHRPLLEGRLSLNYECFKTDFKEQDIKTLPSHLCTSALLSKMVLIALRKETVLENNELEKIIAELLYSLQWCEELDNPPIFLIGFCEILQKMNITYDNLRVLGNTSGLLQLLFNRSREHGTLWSLIIAKLILSRSISSDEVKPHYKRKESFFPLTEGNLHTIQSLCPFLSKEEKKEFSAQCIPALLGWTKKDLCSTNGGFGHLAIFNSCLQTKSIDDGELLHGILKIIISWKKEHEDIFLFSCNLSEASPEVLGVNIEIIRFLSLFLKYCSSPLAESEWDFIMCSMLAWLETTSENQALYSIPLVQLFACVSCDLACDLSAFFDSTTLDTIGNLPVNLISEWKEFFSQGIHSLLLPILVTVTGENKDVSETSFQNAMLKPMCETLTYISKEQLLSHKLPARLVADQKTNLPEYLQTLLNTLAPLLLFRARPVQIAVYHMLYKLMPELPQYDQDNLKSYGDEEEEPALSPPAALMSLLSIQEDLLENVLGCIPVGQIVTIKPLSEDFCYVLGYLLTWKLILTFFKAASSQVNKYVTTFDSSVLICF

SEQ ID NO: 841289 - protein, 260 aa, Homo sapiens
FFALHQLRALYSMYLRKTKSLNKLLYHLFRLMPENPTYAETAVEVPNKDPKTFFTEELQLSIRETTMLPYHIPHLACSVYHMTFFNIVDRFTSKYVSSVLSFQEISSVQTSTQLFNGMTVKARATTREVMATYTIEDIVIELIIQLPSNYPLGSIIVESGKRVGVAVQQWRNWMLQLSTYLTHQNGSIMEGLALWKNNVDKRFEGVEDCMICFSVIHGFNYSLPKKACRTCKKKFHSACLYKWFTSSNKSTCPLCRETFF

SEQ ID NO: 841290 - protein, 166 aa, Homo sapiens
SSYMSEFSGDLNRGIEDCLGIPHEELLKICKYIQETQETERMTLRFSHISLLAIPHILGRLLPLHLSIFPLQGMLESHISPWLTLLPSSSLCSNRFNQPIGNTTSQFLALPNPFPVLFHSPSYVLLRYLLFVFLPSLECKLYDVGDSQGSFSLRPRYLEDHRRGTL

SEQ ID NO: 841291 - protein, 408 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRIP

SEQ ID NO: 841292 - protein, 151 aa, Homo sapiens
GFRPRFRTACSSLARTSSAEYNVNNLVSPVLFQEALWHVPEHAVVLEIRPRLLLDEFLGYDDILMSSVKGLAENEENKGFLRNVVSGEHYRFVSMWMARTSYLAAFAIMVIFTLSVSMLLRYSHHQIFVFIVDLLQMLEMDMASPSQSRIV

SEQ ID NO: 841293 - protein, 620 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841294 - protein, 677 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRRAWRGGRVEWVLVGRGRGLPEGGALEAGVVAAPRGNPRGWAWQGGTCSPDALTPPRRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841295 - protein, 480 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQQVRIQEMLLQAPPLGPGTPTALPGRRLSSPWCEVAPEACTR

SEQ ID NO: 841296 - protein, 617 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSESHSGMEWAGGQTSHSGRNAEERSFHSI

SEQ ID NO: 841297 - protein, 711 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLGESELLGLGSSMAGPPLLPRVSSCWCGTGGCAGSTGVCPAPGTLPRAGVLDGFPKNGQGQEAGQASAMEPAGAGPRGGLGGAPGSLIHPPADPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841298 - protein, 668 aa, Homo sapiens
MSWGNICYQTPLVLWKACRLTQRPDPGVHAPLSQQGILEKELLVRYLEQRRGKSRAIGCNEVTPFCPTTSGSDFPSIPYYNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841299 - protein, 420 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRLLSLRPRRFLHITR

SEQ ID NO: 841300 - protein, 406 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLR

SEQ ID NO: 841301 - protein, 794 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLGESELLGLGSSMAGPPLLPRVSSCWCGTGGCAGSTGVCPAPGTLPRAGVLDGFPKNGQGQEAGQASAMEPAGAGPRGGLGGAPGSLIHPPADPTRDQCFGDRFSRLLLDEFLGYDDILMSSVKGLAENEENKGFLRNVVSGEHYRFVSMWMARTSYLAAFAIMVIFTLSVSMLLRYSHHQIFVFIGECPAGAGRGGRPPGPHRAPAALLPAVDLLQMLEMNMAIAFPAAPLLTVILALVGMEAIMSEFFNDTTTAFYIILIVWLADQYDAICCHTSTSKRHWLRRAWRGGRVEWVLVGRGRGLPEGGALEAGVVAAPRGNPRGWAWQGGTCSPDALTPPRRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841302 - protein, 423 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKGPHPAPQFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841303 - protein, 497 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLGESELLGLGSSMAGPPLLPRVSSCWCGTGGCAGSTGVCPAPGTLPRAGVLDGFPKNGQGQEAGQASAMEPAGAGPRGGLGGAPGSLIHPPADPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLR

SEQ ID NO: 841304 - protein, 462 aa, Homo sapiens
KNRCLATLRSNFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841305 - protein, 166 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCGVQPARWALLGASPTPPRTVSPRVTPQLLTQLPWGLR

SEQ ID NO: 841306 - protein, 184 aa, Homo sapiens
FQKGLQFPLDFAHKGGPQKVRAVYSCTREAPARIFSSASCPLLRYSHHQIFVFIAPLLTVILALVGMEAIMSEFFNDTTTAFYIILIVWLADQYDAICCHTSTSKRHWLRFFYLYHFAFYAYHYRFNGQYSSLALVTSWLFIQQVRIQEMLLQAPPLGPGTPTALPGRRLSSPWCEVAPEACTR

SEQ ID NO: 841307 - protein, 166 aa, Homo sapiens; identical to SEQ ID NO: 841305

SEQ ID NO: 841308 - protein, 96 aa, Homo sapiens
GREKRTWCGIRRVVDLLQMLEMNMAIAFPAAPLLTVILALVGMEAIMSEFFNDTTTAFYIILIVWLADQYDAICCHTSTSKRHWLRLLSLPPQCRN

SEQ ID NO: 841309 - protein, 603 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841310 - protein, 620 aa, Homo sapiens; identical to SEQ ID NO: 841293

SEQ ID NO: 841311 - protein, 574 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGGQTSHSGRNAEERSFHSI

SEQ ID NO: 841312 - protein, 666 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLGESELLGLGSSMAGPPLLPRVSSCWCGTGGCAGSTGAPGSLIHPPADPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841313 - protein, 416 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRLLSLPPQCRN

SEQ ID NO: 841314 - protein, 626 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKVPGRPQFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841315 - protein, 718 aa, Homo sapiens
GRSCPAWRLASVSSAAAGRESGRWRRRPGGREESGGCEGGRWRPGGALGHLRVVRARRWEACRSTWSPQLRGPGPTAAAAARPPRAGLAPPISTPTPSSTCATGSSTRCSSRWLSPIRGSSRPPSAVSSSSSCCSSDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLGESELLGLGSSMAGPPLLPRVSSCWCGTGGCAGSTGVCPAPGTLPRAGVLDGFPKNGQGQEAGQASAMEPAGAGPRGGLGGAPGSLIHPPADPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841316 - protein, 280 aa, Homo sapiens
MQDMKKKSAIEHLEPVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841317 - protein, 140 aa, Homo sapiens
KKAAATKKPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 841318 - protein, 160 aa, Homo sapiens [sequence omitted]

SEQ ID NO: 841319 - protein, 160 aa, Homo sapiens [sequence omitted]

SEQ ID NO: 841320 - protein, 160 aa, Homo sapiens [sequence omitted]

SEQ ID NO: 841321 - protein, 132 aa, Homo sapiens
MELFLWPHICESIRKGMGTVQKGMPHKCYHGKTGRVYNVTQHAVGIVVNKQVKGKILAKRINVRIEHIKHSKSRDSFLKRVKENDQKKKEAKEKGTWVQLKRQPAPPREAHFVRTNGKEPELLEPIPYEFMA

SEQ ID NO: 841322 - protein, 64 aa, Homo sapiens
MTHSGTESTIKNNHSGPQTRHGNDTHPGGTASTTSELHNTHSEARKRINGQQENIIEDTEKHNA

SEQ ID NO: 841323 - protein, 83 aa, Homo sapiens
SLGAKTSGWNGCAWEPAETDAAEATVKKKEIGACLEPTPTFEGPDRATSQLPGLVVASSLQKPWKSLESVFPGWGCQITPVGG

SEQ ID NO: 841324 - protein, 42 aa, Homo sapiens
VCFCMNSPRSVFAAGPHSRLFVSGPDVFSVLQNHLEKRELDI

SEQ ID NO: 841325 - protein, 93 aa, Homo sapiens
AATFIKDTLVKLKAHIAPHTITVGDFNTPLSSMDRSWKQKLNRDTVKLTKVMKQMDLTVINRTFCPKTKGYTFFSAPHGTFSKIDHILGHKTG

SEQ ID NO: 841326 - protein, 83 aa, Homo sapiens
LRIPHTPKAHTEQILMDEVVAAHAELTIHTQIAVDEVVANLNGQKLLRPDSYFSDFQPFSFVRALYIYHETTAPSLICHISFS

SEQ ID NO: 841327 - protein, 38 aa, Homo sapiens
MRAEQKEPALRSPNTEIPLEGRVVEEEEEFSQEEEEFA

SEQ ID NO: 841328 - protein, 173 aa, Homo sapiens
KRRSNRQVKRKKYTEDLDIKITDDEEEEEVDVTGPIKPEPILPEPVQEPDGETLPSMQFFVENPSEEDAAIVDKVLSMRIVKKELPSGQYTEAEEFFVKYKNYSYLHCEWATISQLEKDKRIHQKLKRFKTKMAQMRHFFHEDEEPFNPDYVEVDRILDESHSIDKDNGEVSC

SEQ ID NO: 841329 - protein, 482 aa, Homo sapiens
LFPGIAMETPGASASSLLLPAASRPPRKREAGEAGAATSKQRVLDEEEYIEGLQTVIQRDFFPDVEKLQAQKEYLEAEENGDLERMRQIAIKFGSALGKMSREPPPPYVTPATFETPEVHAGTGVVGNKPRPRGRGLEDGEAGEEEEKEPLPSLDVFLSRYTSEDNASFQEIMEVAKERSRARHAWLYQAEEEFEKRQKDNLELPSAEHQAIESSQASVETWKYKAKNSLMYYPEGVPDEEQLFKKPRQVVHKNTRFLRDPFSQALSRCQLQQAAALNAQHKQGKVGPDGKELIPQESPRVGGFGFVATPSPAPGVNESPMMTWGEVENTPLRVEGSETPYVDRTPGPAFKILEPGRRERLGLKMANEAAAKNRAKKQEALRRVTENLASLTPKGLSPAMSPALQRLVSRTASKYTDRALRASYTPSPARSTHLKTPASGLQTPTSTPAPGSATRTPLTQDPASITDNLLQLPARRKASDFF

SEQ ID NO: 841330 - protein, 588 aa, Homo sapiens
LFPGIAMETPGASASSLLLPAASRPPRKREAGEAGAATSKQRVLDEEEYIEGLQTVIQRDFFPDVEKLQAQKEYLEAEENGDLERMRQIAIKFGSALGKMSREPPPPYVTPATFETPEVHAGTGVVGNKPRPRGRGLEDGEAGEEEEKEPLPSLDVFLSRYTSEDNASFQEIMEVAKERSRARHAWLYQAEEEFEKRQKDNLELPSAEHQAIESSQASVETWKYKAKNSLMYYPEGKWRASQPNGEVLGRAVCVWLCLEQPPGVYGRAPLQFGLLMGTGLSKGGQVCVRSAVSETLSSGTGACVLLNAFVHLGVTWPRSELLMLLRLLPFCHLLLPLLRLPGVPDEEQLFKKPRQVVHKNTRFLRDPFSQALSRCQLQQAAALNAQHKQGKVGPDGKELIPQESPRVGGFGFVATPSPAPGVNESPMMTWGEVENTPLRVEGSETPYVDRTPGPAFKILEPGRRERLGLKMANEAAAKNRAKKQEALRRVTENLASLTPKGLSPAMSPALQRLVSRTASKYTDRALRASYTPSPARSTHLKTPASGLQTPTSTPAPGSATRTPLTQDPASITDNLLQLPARRKASDFF

SEQ ID NO: 841331 - protein, 472 aa, Homo sapiens
SVTLRKALEFKTSRPPRKREAGEAGAATSKQRVLDEEEYIEGLQTVIQRDFFPDVEKLQAQKEYLEAEENGDLERMRQIAIKFGSALGKMSREPPPPYVTPATFETPEVHAGTGVVGNKPRPRGRGLEDGEAGEEEEKEPLPSLDVFLSRYTSEDNASFQEIMEVAKERSRARHAWLYQAEEEFEKRQKDNLELPSAEHQAIESSQASVETWKYKAKNSLMYYPEGVPDEEQLFKKPRQVVHKNTRFLRDPFSQALSRCQLQQAAALNAQHKQGKVGPDGKELIPQESPRVGGFGFVATPSPAPGVNESPMMTWGEVENTPLRVEGSETPYVDRTPGPAFKILEPGRRERLGLKMANEAAAKNRAKKQEALRRVTENLASLTPKGLSPAMSPALQRLVSRTASKYTDRALRASYTPSPARSTHLKTPASGLQTPTSTPAPGSATRTPLTQDPASITDNLLQLPARRKASDFF

SEQ ID NO: 841332 - protein, 632 aa, Homo sapiens
AFSWDSDGDAGRISVVLVASRRVQAPEEARGGRGWGCDEQAAGPGRGRVYRGTTSVRTPATSGPILCFKLLSGSLSRVLTLRLLVEVEEPGVDGPTSQVNRAEEDVCGGRGCSSVVREKRERLSLYGTGVRERRFSVKVLSRSLTNWKDGGKEGFLKSGGSKCECWGSWKETAVVTASRVSGPASPHHRTQKEELKRGLAEGLQTVIQRDFFPDVEKLQAQKEYLEAEENGDLERMRQIAIKFGSALGKMSREPPPPYVTPATFETPEVHAGTGVVGNKPRPRGRGLEDGEAGEEEEKEPLPSLDVFLSRYTSEDNASFQEIMEVAKERSRARHAWLYQAEEEFEKRQKDNLELPSAEHQAIESSQASVETWKYKAKNSLMYYPEGVPDEEQLFKKPRQVVHKNTRFLRDPFSQALSRCQLQQAAALNAQHKQGKVGPDGKELIPQESPRVGGFGFVATPSPAPGVNESPMMTWGEVENTPLRVEGSETPYVDRTPGPAFKILEPGRRERLGLKMANEAAAKNRAKKQEALRRVTENLASLTPKGLSPAMSPALQRLVSRTASKYTDRALRASYTPSPARSTHLKTPASGLQTPTSTPAPGSATRTPLTQDPASITDNLLQLPARRKASDFF

SEQ ID NO: 841333 - protein, 469 aa, Homo sapiens
LFPGIAMETPGASASSLLLPAASRPPRKREAGEAGAATSKQRVLDEEEYIEGLQTVIQRDFFPDVEKLQAQKEYLEAEENGDLERMRQIAIKFGSALGKMSREPPPPYVTPATFETPEVHAGTGVVGNKPRPRGRGLEDGEAGEEEEKEPLPSLDVFLSRYTSEDNASFQEIMEVAKERSRARHAWLYQAEEEFEKRQKDNLELPSAEHQAIESSQASVETWKYKAKNSLMYYPEGVPDEEQLFKKPRQVVHKNTRFLRDPFSQALSRCQLQQAAALNAQHKQGKVGPDGKELIPQESPRVGGFGFVATPSPAPGVNESPMMTWGEVENTPLRVEGSETPYVDRTPGPAFKILEPGRRERLGLKMANEAAAKNRAKKQEALRRVTENLASLTPKGLSPAMSPALQRLVSRTASKPRPVGCRPPQAHRRLALPHAPLSHRTRPPSRTTCCSSLPGAKLRTSFRARPGLGS

SEQ ID NO: 841334 - protein, 118 aa, Homo sapiens
MANEAAAKNRAKKQEALRRVTENLASLTPKGLSPAMSPALQRLVSRTASKYTDRALRASYTPSPARSTHLKTPASGLQTPTSTPAPGSATRTPLTQDPASITDNLLQLPARRKASDFF

SEQ ID NO: 841335 - protein, 128 aa, Homo sapiens
PSLSARRLNSSVQAPEEARGGRGWGCDEQAAGPGRGRVYRGTTSVRTPATSGPILCFKLLSGSLSRVLTLRLLVEVEEPGVDGPTSQVNRAEEDVCGGRGCSSVVREKRERTDNLLQLPARRKASDFF

SEQ ID NO: 841336 - protein, 144 aa, Homo sapiens
FPERLSEVMVLGGTRRQVRSAAPWAGQVGFGAFQGLLVGGDGLWGFCRQQREAGTHHSGFLCEGLPGVWQAWRSYPHTCYLVDPGARPQGAAGSEDGQRGRCQEPGQEAGSLAESDGESGQVRGRLAGGEVRGWLWPAPVRPLP

SEQ ID NO: 841337 - protein, 482 aa, Homo sapiens; identical to SEQ ID NO: 841329

SEQ ID NO: 841338 - protein, 610 aa, Homo sapiens
AFSWDSDGDAGRISVVLVASRRVQAPEEARGGRGWGCDEQAAGPGRGRVYRGTTSVRTPATSGPILCFKLLSGSLSRVLTLRLLVEVEEPGVDGPTSQVNRAEEDVCGGRGCSSVVREKRERLSLYGTGVRERRFSVKVLSRSLTNWKDGGKEGFLKSGGSKCECWGSWKETAVVTASRGLQTVIQRDFFPDVEKLQAQKEYLEAEENGDLERMRQIAIKFGSALGKMSREPPPPYVTPATFETPEVHAGTGVVGNKPRPRGRGLEDGEAGEEEEKEPLPSLDVFLSRYTSEDNASFQEIMEVAKERSRARHAWLYQAEEEFEKRQKDNLELPSAEHQAIESSQASVETWKYKAKNSLMYYPEGVPDEEQLFKKPRQVVHKNTRFLRDPFSQALSRCQLQQAAALNAQHKQGKVGPDGKELIPQESPRVGGFGFVATPSPAPGVNESPMMTWGEVENTPLRVEGSETPYVDRTPGPAFKILEPGRRERLGLKMANEAAAKNRAKKQEALRRVTENLASLTPKGLSPAMSPALQRLVSRTASKYTDRALRASYTPSPARSTHLKTPASGLQTPTSTPAPGSATRTPLTQDPASITDNLLQLPARRKASDFF

SEQ ID NO: 841339 - protein, 310 aa, Homo sapiens
MEVAKERSRARHAWLYQAEEEFEKRQKDNLELPSAEHQAIESSQASVETWKYKAKNSLMYYPEGVPDEEQLFKKPRQVVHKNTRFLRDPFSQALSRCQLQQAAALNAQHKQGKVGPDGKELIPQESPRVGGFGFVATPSPAPGVNESPMMTWGEVENTPLRVEGSETPYVDRTPGPAFKILEPGRRERLGLKMANEAAAKNRAKKQEALRRVTENLASLTPKGLSPAMSPALQRLVSRTASKYTDRALRASYTPSPARSTHLKTPASGLQTPTSTPAPGSATRTPLTQDPASITDNLLQLPARRKASDFF

SEQ ID NO: 841340 - protein, 104 aa, Homo sapiens
PSLSARRLNSSVQAPEEARGGRGWGCDEQAAGPGRGRVYRGTTSVRTPATSGPILCFKLLSGSLSRVLTLRLLVEVEEPGVDGPTSQTDNLLQLPARRKASDFF

SEQ ID NO: 841341 - protein, 83 aa, Homo sapiens
DPHHLHPITYTSIIYTPSPTPRSSIPHHLHLNHLYPITYTLIIYTPSPTSRSSISQSSTPHHLQPDHLYPDHLQPDHLYPITY

SEQ ID NO: 841342 - protein, 73 aa, Homo sapiens
SATIISLSSSSIPPPLLTAAHRLGRVEFGAQLPPNPATTSTALSHTHADFSLAYGHKSVIRWVHVLSLFQASS

SEQ ID NO: 841343 - protein, 112 aa, Homo sapiens
MRLFSAATASRVSVPRSPPPRLLPLPRHESGFLPWRVAETSSPSPHLGSPPALASSGDALGPGAVGSMEGRWLPVIGVVFCAVQLLPCGPLALPRAGARRPGRCCSCFQLTA

SEQ ID NO: 841344 - protein, 108 aa, Homo sapiens
LGVNRPRAAMSKPRASRPAHSDSEQSLSFDPSPAPFPGTPAPRAALPTCLAMETPVPAAAPPCSGAQASSTPLSPTRITLCLHVRMDVTLACACSHCICLVLCLYILT

SEQ ID NO: 841345 - protein, 127 aa, Homo sapiens
RDVAFGLSSQLRGKLGVGWKSRVDPGARPRGEVLGREDKARSSDGGRAGLCVLWGPGKGARLGLEPPGKGWGPLIPKQQAISPRPPPAPPVSEISEAPTGKVSSPASACPWLLASNTWGIMMLPVVS

SEQ ID NO: 841346 - protein, 467 aa, Homo sapiens
MGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKAFCQRLRSPGGRTHLLWLFCLQCHGHSHATAVWGAVGVAASGTIWSPAPTSWATPAPEPRAPRTAASCNLGPARQGWGWRLPASSSPHAHPLPCTSWEGA

SEQ ID NO: 841347 - protein, 467 aa, Homo sapiens; identical to SEQ ID NO: 841346

SEQ ID NO: 841348 - protein, 351 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 841349 - protein, 354 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMVSRPGPGCLLDEAPPDGQHRSQLPPTQVCQFRAPF

SEQ ID NO: 841350 - protein, 351 aa, Homo sapiens; identical to SEQ ID NO: 841348

SEQ ID NO: 841351 - protein, 441 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKAFCQRLRSPGGRTHLLWLFCLQCHGHSHATAVWGAVGVAASGTIWSPAPTSWATPAPEPRAPRTAASCNLGPARQGWGWRLPASSSPHAHPLPCTSWEGA

SEQ ID NO: 841352 - protein, 351 aa, Homo sapiens; identical to SEQ ID NO: 841348

SEQ ID NO: 841353 - protein, 351 aa, Homo sapiens; identical to SEQ ID NO: 841348

SEQ ID NO: 841354 - protein, 351 aa, Homo sapiens; identical to SEQ ID NO: 841348

SEQ ID NO: 841355 - protein, 467 aa, Homo sapiens; identical to SEQ ID NO: 841346

SEQ ID NO: 841356 - protein, 333 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTTIWSPAPTSWATPAPEPRAPRTAASCNLGPARQGWGWRLPASSSPHAHPLPCTSWEGA

SEQ ID NO: 841357 - protein, 467 aa, Homo sapiens; identical to SEQ ID NO: 841346

SEQ ID NO: 841358 - protein, 354 aa, Homo sapiens; identical to SEQ ID NO: 841349

SEQ ID NO: 841359 - protein, 303 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTILGLQGSWGANPQPPNGPLVVGKGTTTL

SEQ ID NO: 841360 - protein, 229 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSHPGDPVTWCLRGRHRGFSASLLWTAGSLPGPASERERERERTA

SEQ ID NO: 841361 - protein, 218 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHASWCAQ

SEQ ID NO: 841362 - protein, 199 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYREALEGRRRKGYAVRKAYRARGAFPPLPHGGPSHRTGPRPVSRR

SEQ ID NO: 841363 - protein, 234 aa, Homo sapiens
MGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKAFCQRLRSPGGRTHLLWLFCLQCHGHSHATAVWGAVGVAASGTIWSPAPTSWATPAPEPRAPRTAASCNLGPARQGWGWRLPASSSPHAHPLPCTSWEGA

SEQ ID NO: 841364 - protein, 206 aa, Homo sapiens
TDVLVRGRVLIGRGSAAPTPANPDPEVRQRPAQIPTPARSKPRASRPAHSDSEQSLSFDPSPAPFPGTPAPRAALPTCLAMETPVPAAAPPCSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARQYQEGG

SEQ ID NO: 841365 - protein, 206 aa, Homo sapiens; identical to SEQ ID NO: 841364

SEQ ID NO: 841366 - protein, 206 aa, Homo sapiens; identical to SEQ ID NO: 841364

SEQ ID NO: 841367 - protein, 206 aa, Homo sapiens; identical to SEQ ID NO: 841364

SEQ ID NO: 841368 - protein, 310 aa, Homo sapiens
MACNRQEKQIETREGQQRESTRRTNKHRQCPPRARDQRVMSDNREAKSQAKRGGRMEVGEAAQPSQSGASSGASRQARGKQRSQGQRKERSKEHEEVRAEGKERDGRTKEKRAKEERKGRRGESYACPQALLCKRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 841369 - protein, 44 aa, Homo sapiens
LEAAPASAPSLGPRYDFAAQPGLHARLASSGVISSFRLPLASGI

SEQ ID NO: 841370 - protein, 143 aa, Homo sapiens
GRVRGEGVVCGNRAGMKLANAARPLPGPAPAPRRPVLGARFFMEMRRGGRGRGRGAGSRPRSLTAAFSLAPLSPLPAALTLRFPLPLSQSRSRSPAAGRGSRQRRQSPQQRWGESWALRVVGARKGCQAGAGTPWQRMGSPHP

SEQ ID NO: 841371 - protein, 164 aa, Homo sapiens
LVPNLARAKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 841372 - protein, 467 aa, Homo sapiens; identical to SEQ ID NO: 841346

SEQ ID NO: 841373 - protein, 351 aa, Homo sapiens; identical to SEQ ID NO: 841348

SEQ ID NO: 841374 - protein, 354 aa, Homo sapiens; identical to SEQ ID NO: 841349

SEQ ID NO: 841375 - protein, 446 aa, Homo sapiens
MGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMAPTAAARGTPLSTTCARAPCCAGPAGSLPTRHSASGSGAQVGGPISSGSSASSVTVTRTLPQCGGQWGWQLRGQSGHPLLPPGQLQPPNPEPPELQHHVIWDLPGRGGGGGFLRPPHLMPTPCPARHGRGLEAKEK

SEQ ID NO: 841376 - protein, 220 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSPHALAGAWPWRRWMRRASLSGCATSPMRTSPWAIGRSSARMEMIPC

SEQ ID NO: 841377 - protein, 351 aa, Homo sapiens; identical to SEQ ID NO: 841348

SEQ ID NO: 841378 - protein, 351 aa, Homo sapiens; identical to SEQ ID NO: 841348

SEQ ID NO: 841379 - protein, 450 aa, Homo sapiens
MGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKAFCQRLRSPGGRTHLLWLFCLQCHGHSHATAVWGAVGVAASGTIWSPAPTSWATPAPEPRAPRTAASCNLGPARQEVVVFLLI

SEQ ID NO: 841380 - protein, 270 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQQTIWSPAPTSWATPAPEPRAPRTAASCNLGPARQGWGWRLPASSSPHAHPLPCTSWEGA

SEQ ID NO: 841381 - protein, 319 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATQSPYDLCGGQKLGWGQAGEVLIHGEKAPGGHWFCP

SEQ ID NO: 841382 - protein, 269 aa, Homo sapiens
MGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHSPPTDLVWKAQNTWGCGNSLRTALINSTGEEVAMRKLVRSVTVVEDDEDEDGDDLLHHHHVSGSRR

SEQ ID NO: 841383 - protein, 206 aa, Homo sapiens; identical to SEQ ID NO: 841364

SEQ ID NO: 841384 - protein, 476 aa, Homo sapiens
MRPDWWRLTMGSSVSLRAGWRMRCRNCGAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKAFCQRLRSPGGRTHLLWLFCLQCHGHSHATAVWGAVGVAASGTIWSPAPTSWATPAPEPRAPRTAASCNLGPARQGWGWRLPASSSPHAHPLPCTSWEGA

SEQ ID NO: 841385 - protein, 206 aa, Homo sapiens; identical to SEQ ID NO: 841364

SEQ ID NO: 841386 - protein, 435 aa, Homo sapiens
MACNRQEKQIETREGQQRESTRRTNKHRQCPPRARDQRVMSDNREAKSQAKRGGRMEVGEAAQPSQSGASSGASRQARGKQRSQGQRKERSKEHEEVRAEGKERDGRTKEKRAKEERKGRRGESYACPQALLCKRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKAFCQRLRSPGGRTHLLWLFCLQCHGHSHATAVWGAVGVAASGTIWSPAPTSWATPAPEPRAPRTAASCNLGPARQGWGWRLPASSSPHAHPLPCTSWEGA

SEQ ID NO: 841387 - protein, 235 aa, Homo sapiens
DLRASTRPGVNRPNPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKAFCQRLRSPGGRTHLLWLFCLQCHGHSHATAVWGAVGVAASGTIWSPAPTSWATPAPEPRAPRTAASCNLGPARQGWGWRLPASSSPHAHPLPCTSWEGA

SEQ ID NO: 841388 - protein, 188 aa, Homo sapiens
MGGTHNGRRTLYNTTRDARREAEKQTTKRERGDTEKTRREQKRREKRTHKPGRERKHKKEEKKNKIKRRKEKESARRGKHKKKKEKREEINGGRKNPTTGQHKARKGGEKKNTENDERTETKRQKQQKYDNEREEDTRTKQTKGNRRRKQQPTRDEQRQRKTDTTKEESKKKQQKHKQRAKSKNKEAN

SEQ ID NO: 841389 - protein, 81 aa, Homo sapiens
ADGWSDTEEPQKHPPCCCPEEAGTEGHALYDLIHGKRTEARPAQGWEEGAQERRLWGWCFSRRGWLAHPGTAPQWGWTGCR

SEQ ID NO: 841390 - protein, 933 aa, Homo sapiens
QVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGLAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRELFPAALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 841391 - protein, 778 aa, Homo sapiens
QVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGLAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRELFPAALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 841392 - protein, 1025 aa, Homo sapiens
QVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGLAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRELFPAALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 841393 - protein, 522 aa, Homo sapiens
QVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGLAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEGECRAGRDPVTVCAFSQAPFWAPMVTLTQY

SEQ ID NO: 841394 - protein, 31 aa, Homo sapiens
MSQGGVGNRKGLLYEEVTFKSKRQRIEHTDI

SEQ ID NO: 841395 - protein, 50 aa, Homo sapiens
RPKEVTPPWQPHGQGGTFLLGQIQELRELAFPGNVDGSRKVPNPGASHLD

SEQ ID NO: 841396 - protein, 109 aa, Homo sapiens
MSHSVFLNIYLSIYLSIYLSIYLTIYLLSIVCLLLVYLPIIYLYHQSTNLSLYLSISIYLPIYVSIYHLSVMHLPITYLPTYHHQSANLSLYLPIIYLSIYLCIICLPI

SEQ ID NO: 841397 - protein, 1382 aa, Homo sapiens
MQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGDALRKPRLQKPITGHLDDLFFTLYPSLEKFEEELLELHVQDHFQEGCGPLDGGALEILERRLRVGVHNGLGFVQRPQVVVLVPEMDVALTRSASFSRKVVSSSKTSSGSQALVLRSRLRLPEMVGHPAFAVIFQLEYVFSSPAGVDGNAASVTSLSNLACMHMVRWAVWNPLLEADSGRVTLPLQGGIQPNPSHCLVYKVPSASMSSEEVKQVESGTLRFQFSLGSEEHLDAPTEPVSGPKVERRPSRKPPTSPSSPPAPVPRVLAAPQNSPVGPGLSISQLAASPRSPTQHCLARPTSQLPHGSQASPAQAEFPLEAGISHLEADLSQTSLVLETSIAEQLQELPFTPLHAPIVVGTQTRSSAGQPSRASMVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKHLLRQGRPAVQASHELEVVATEYEQDNMVVSGDMLGFGRVKPIGVHSVVKGRLHLTLANVGHPCEQKVRGCSTLPPSRSRVISNDGASRFSGGSLLTTGSSRRKHVVQAQKLADVDSELAAMLLTHARQGKGPQDVSRESDATRRRKLERMRSVRLQEAGGDLGRRGTSVLAQQSVRTQHLRDLQVIAAYRERTKAESIASLLSLAITTEHTLHATLGVAEFFEFVLKNPHNTQHTVTVEIDNPELSVIVDSQEWRDFKGAAGLHTPVEEDMFHLRGSLAPQLYLRPHETAHVPFKFQSFSAGQLAMVQASPGLSNEKGMDAVSPWKSSAVPTKHAKVLFRASGGKPIAVLCLTVELQPHVVDQVFRFYHPELSFLKKAIRLPPWHTFPGAPVGMLGEDPPVHVRCSDPNVICETQNVGPGEPRDIFLKVASGPSPEIKDFFVIIYSDRWLATPTQTWQVYLHSLQRVDVSCVAGQLTRLSLVLRGTQTVRKVRAFTSHPQELKTDPKGVFVLPPRGVQDLHVGVRPLRAGSRFVHLNLVDVDCHQLVASWLVCLCCRQPLISKAFEIMLAAGEGKGVNKRITYTNPYPSRRTFHLHSDHPELLRFREDSFQVGGGETYTIGLQFAPSQRVGEEEILIYINDHEDKNEEAFCVKVIYQ

SEQ ID NO: 841398 - protein, 1396 aa, Homo sapiens
MQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGDALRKPRLQKPITGHLDDLFFTLYPSLEKFEEELLELHVQDHFQEGCGPLDGGALEILERRLRVGVHNGLGFVQRPQVVVLVPEMDVALTRSASFSRKVVSSSKTSSGSQALVLRSRLRLPEMVGHPAFAVIFQLEYVFSSPAGVDGNAASVTSLSNLACMHMVRWAVWNPLLEADSGRVTLPLQGGIQPNPSHCLVYKVPSASMSSEEVKQVESGTLRFQFSLGSEEHLDAPTEPVSGPKVERRPSRKPPTSPSSPPAPVPRVLAAPQNSPVGPGLSISQLAASPRSPTQHCLARPTSQLPHGSQASPAQAEFPLEAGISHLEADLSQTSLVLETSIAEQLQELPFTPLHAPIVVGTQTRSSAGQPSRASMVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKETSHIFSVSQLTEVPESSTVYAVIVCSVDECGKATRVCGDRKPPDPQGKGQHLLRQGRPAVQASHELEVVATEYEQDNMVVSGDMLGFGRVKPIGVHSVVKGRLHLTLANVGHPCEQKVRGCSTLPPSRSRVISNDGASRFSGGSLLTTGSSRRKHVVQAQKLADVDSELAAMLLTHARQGKGPQDVSRESDATRRRKLERMRSVRLQEAGGDLGRRGTSVLAQQSVRTQHLRDLQVIAAYRERTKAESIASLLSLAITTEHTLHATLGVAEFFEFVLKNPHNTQHTVTVEIDNPELSVIVDSQEWRDFKGAAGLHTPVEEDMFHLRGSLAPQLYLRPHETAHVPFKFQSFSAGQLAMVQASPGLSNEKGMDAVSPWKSSAVPTKHAKVLFRASGGKPIAVLCLTVELQPHVVDQVFRFYHPELSFLKKAIRLPPWHTFPGAPVGMLGEDPPVHVRCSDPNVICETQNVGPGEPRDIFLKVASGPSPEIKDFFVIIYSDRWLATPTQTWQVYLHSLQRVDVSCVAGQLTRLSLVLRGTQTVRKVRAFTSHPQELKTDPKGVFVLPPRGVQDLHVGVRPLRAGSRFVHLNLVDVDCHQLVASWLVCLCCRQPLISKAFEIMLAAGEGKGVNKRITYTNPYPSRRTFHLHSDHPELLRFREDSFQVWWGCAWDS

SEQ ID NO: 841399 - protein, 666 aa, Homo sapiens
MVGPGFLKPGERRCFARYLAVQTLQIDVWDGDSLLLIGSAAVQMKHLLRQGRPAVQASHELEVVATEYEQDNMVVSGDMLGFGRVKPIGVHSVVKGRLHLTLANVGHPCEQKVRGCSTLPPSRSRVISNDGASRFSGGSLLTTGSSRRKHVVQAQKLADVDSELAAMLLTHARQGKGPQDVSRESDATRRRKLERMRSVRLQEAGGDLGRRGTSVLAQQSVRTQHLRDLQVIAAYRERTKAESIASLLSLAITTEHTLHATLGVAEFFEFVLKNPHNTQHTVTVEIDNPELSVIVDSQEWRDFKGAAGLHTPVEEDMFHLRGSLAPQLYLRPHETAHVPFKFQSFSAGQLAMVQASPGLSNEKGMDAVSPWKSSAVPTKHAKVLFRASGGKPIAVLCLTVELQPHVVDQVFRFYHPELSFLKKAIRLPPWHTFPGAPVGMLGEDPPVHVRCSDPNVICETQNVGPGEPRDIFLKVASGPSPEIKDFFVIIYSDRWLATPTQTWQVYLHSLQRVDVSCVAGQLTRLSLVLRGTQTVRKVRAFTSHPQELKTDPKGVFVLPPRGVQDLHVGVRPLRAGSRFVHLNLVDVDCHQLVASWLVCLCCRQPLISKAFEIMLAAGEGKGVNKRITYTNPYPSRRTFHLHSDHPELLRFREDSFQVWWGCAWDS

SEQ ID NO: 841400 - protein, 734 aa, Homo sapiens
MQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGDALRKPRLQKPITGHLDDLFFTLYPSLEKFEEELLELHVQDHFQEGCGPLDGGALEILERRLRVGVHNGLGFVQRPQVVVLVPEMDVALTRSASFSRKVVSSSKTSSGSQALVLRSRLRLPEMVGHPAFAVIFQLEYVFSSPAGVDGNAASVTSLSNLACMHMVRWAVWNPLLEADSGRVTLPLQGGIQPNPSHCLVYKVPSASMSSEEVKQVESGTLRFQFSLGSEEHLDAPTEPVSGPKVERRPSRKPPTSPSSPPAPVPRVLAAPQNSPVGPGLSISQLAASPRSPTQHCLARPTSQLPHGSQASPAQAEFPLEAGISHLEADLSQTSLVLETSIAEQLQELPFTPLHAPIVVGTQTRSSAGQPSRASMVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKETSHIFSVSQ

SEQ ID NO: 841401 - protein, 31 aa, Homo sapiens
MTLIENCSLQYTLKPHPALEPAFHLLPENLL

SEQ ID NO: 841402 - protein, 64 aa, Homo sapiens
RPGTTHDLGLPWLIGLQAPRSPLLAHPERLCSDPPLSLLKTDPKGVFVLPPRGVQDLHVGVRPL

SEQ ID NO: 841403 - protein, 159 aa, Homo sapiens
MNDWHRIFTQNVLVPPHPQRARQPWKESTAFQCVLKWLDGPVIRQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRYLPCFYNP

SEQ ID NO: 841404 - protein, 594 aa, Homo sapiens
MVVSGDMLGFGRVKPIGVHSVVKGRLHLTLANVGHPCEQKVRGCSTLPPSRSRVISNDGASRFSGGSLLTTGSSRRKHVVQAQKLADVDSELAAMLLTHARQGKGPQDVSRESDATRRRKLERMRSVRLQEAGGDLGRRGTSVLAQQSVRTQHLRDLQVIAAYRERTKAESIASLLSLAITTEHTLHATLGVAEFFEFVLKNPHNTQHTVTVEIDNPELSVIVDSQEWRDFKGAAGLHTPVEEDMFHLRGSLAPQLYLRPHETAHVPFKFQSFSAGQLAMVQASPGLSNEKGMDAVSPWKSSAVPTKHAKVLFRASGGKPIAVLCLTVELQPHVVDQVFRFYHPELSFLKKAIRLPPWHTFPGAPVGMLGEDPPVHVRCSDPNVICETQNVGPGEPRDIFLKVASGPSPEIKDFFVIIYSDRWLATPTQTWQVYLHSLQRVDVSCVAGQLTRLSLVLRGTQTVRKVRAFTSHPQELKTDPKGVFVLPPRGVQDLHVGVRPLRAGSRFVHLNLVDVDCHQLVASWLVCLCCRQPLISKAFEIMLAAGEGKGVNKRITYTNPYPSRRTFHLHSDHPELLRFREDSFQVWWGCAWDS

SEQ ID NO: 841405 - protein, 255 aa, Homo sapiens
MCGAFSTQAGAVEKTLFDISPAPGAPVGMLGEDPPVHVRCSDPNVICETQNVGPGEPRDIFLKVASGPSPEIKDFFVIIYSDRWLATPTQTWQVYLHSLQRVDVSCVAGQLTRLSLVLRGTQTVRKVRAFTSHPQELKTDPKGVFVLPPRGVQDLHVGVRPLRAGSRFVHLNLVDVDCHQLVASWLVCLCCRQPLISKAFEIMLAAGEGKGVNKRITYTNPYPSRRTFHLHSDHPELLRFREDSFQVWWGCAWDS

SEQ ID NO: 841406 - protein, 529 aa, Homo sapiens
MQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGDALRKPRLQKPITGHLDDLFFTLYPSLEKFEEELLELHVQDHFQEGCGPLDGGALEILERRLRVGVHNGLGFVQRPQVVVLVPEMDVALTRSASFSRKVVSSSKTSSGSQALVLRSRLRLPEMVGHPAFAVIFQLEYVFSSPAGVDGNAASVTSLSNLACMHMVRWAVWNPLLEADSGRVTLPLQGGIQPNPSHCLVYKVPSASMSSEEVKQVESGTLRFQFSLGSEEHLDAPTEPVSGPKVERRPSRKPPTSPSSPPAPVPRVLAAPQNSPVGPGLSISQLAASPRSPTQHCLARPTSQLPHGSQASPAQAEFPLEAGISHLVLPSTHVGPSLSLLLKMYFMNHPK

SEQ ID NO: 841407 - protein, 33 aa, Homo sapiens
SQKDRKNPLPPSVGVVDKKEETQPPMALKKEGI

SEQ ID NO: 841408 - protein, 58 aa, Homo sapiens
YAKEYRKYLELNNNDIASFLKTYQTQGLLAQEVREVVLTHLREKEILDSSLPSSIIIG

SEQ ID NO: 841409 - protein, 264 aa, Homo sapiens
MDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 841410 - protein, 264 aa, Homo sapiens; identical to SEQ ID NO: 841409

SEQ ID NO: 841411 - protein, 614 aa, Homo sapiens
MNKLNFHNNRVMQDRRSVCIFLPNDESLNIIINVKILCHQLLVQVCDLLRLKDCHLFGLSVIQNNEHVYMELSQKLYKYCPKEWKKEASKGIDQFGPPMIIHFRVQYYVENGRLISDRAARYYYYWHLRKQVLHSQCVLREEAYFLLAAFALQADLGNFKRNKHYGKYFEPEAYFPSWVVSKRGKDYILKHIPNMHKDQFALTASEAHLKYIKEAVRLDDVAVHYYRLYKDKREIEASLTLGLTMRGIQIFQNLDEEKQLLYDFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 841412 - protein, 614 aa, Homo sapiens
MNKLNFHNNRVMQDRRSVCIFLPNDESLNIIINVKILCHQLLVQVCDLLRLKDCHLFGLSVIQNNEHVYMELSQKLYKYCPKEWKKEASKGIDQFGPPMIIHFRVQYYVENGRLISDRAARYYYYWHLRKQVLHSQCVLREEAYFLLAAFALQADLGNFKRNKHYGKYFEPKAYFPSWVVSKRGKDYILKHIPNMHKDQFALTASEAHLKYIKEAVRLDDVAVHYYRLYKDKREIEASLTLGLTMRGIQIFQNLDEEKQLLYDFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 841413 - protein, 264 aa, Homo sapiens; identical to SEQ ID NO: 841409

SEQ ID NO: 841414 - protein, 264 aa, Homo sapiens; identical to SEQ ID NO: 841409

SEQ ID NO: 841415 - protein, 231 aa, Homo sapiens [sequence omitted]

SEQ ID NO: 841416 - protein, 246 aa, Homo sapiens
MDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVFVV

SEQ ID NO: 841417 - protein, 614 aa, Homo sapiens; identical to SEQ ID NO: 841412

SEQ ID NO: 841418 - protein, 264 aa, Homo sapiens; identical to SEQ ID NO: 841409

SEQ ID NO: 841419 - protein, 467 aa, Homo sapiens
MNKLNFHNNRVMQDRRSVCIFLPNDESLNIIINVKILCHQLLVQVCDLLRLKDCHLFGLSVIQNNEHVYMELSQKLYKYCPKEWKKEASKGIDQFGPPMIIHFRVQYYVENGRLISDRAARYYYYWHLRKQVLHSQCVLREEAYFLLAAFALQADLGNFKRNKHYGKYFEPEAYFPSWVVSKRGKDYILKHIPNMHKDQFALTASEAHLKYIKEAVRLDDVAVHYYRLYKDKREIEASLTLGLTMRGIQIFQNLDEEKQLLYDFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDGNSTVPSLALCLVSQFFQALVL

SEQ ID NO: 841420 - protein, 35 aa, Homo sapiens
LILQTICRKPKTSTDRHSLSLDDIRLYQKDFLRIA

SEQ ID NO: 841421 - protein, 82 aa, Homo sapiens
MVRGTREGRGHEGIRLGKTGTSETLNEAVVELSQRAQYQSVIATKRVRRCPERTAPSQATEEMFPETRASFCAHPYLMPLEQ

SEQ ID NO: 841422 - protein, 39 aa, Homo sapiens
MTKWKATCSRHAGVGYRGLRSLGWGRGQCFLIPGTITAA

SEQ ID NO: 841423 - protein, 1258 aa, Homo sapiens
PPRPLLRDDAGVGAPGLPYPLAPGLGGTEGCPRQTDPRTHRPRAQERSRAARRWQPVTMDPPSLDTAIQHALAGLYPPFEATAPTVLGQVFRLLDSGFQGDGLSFLLDFLIPAKRLCEQVREAACAPYSHCLFLHEGWPLCLRDEVVVHLAPLNPLLLRQGDFYLQVEPQEEQSVCIMIKCLSLDLCTVDKKPVPEPAYPILFTQEWLEAINSDFEGNPLHNCLVASENGIAPVPWTKITSPEFVDDRPQVVNALCQAWGPLPLEALDLSSPQELHQASSPDNQVLPAQSLAKGKGRTYGSKYPGLIKVEQARCGEVAFRMDEVVSQDFEGDYVALLGFSQESRGESPSREAGTSSGCTSGALEEIAGTKETPLFQKILPLSEANEGPSLGNRACTKPESSEERPYNLGFRRKVNLKAPTHNSERPPQGSYMNVLEDALDCASGLRAGVSQEPAASKMQGPLGNPENMVQLRPGPRQASSPRLSPASPAAAASETKIEVKTKERNGRLPKPMPCPSRNTSSPEPPTPGLKFSFLRGQRQPSVTPEKASLQHNGPWKVLCSLYSPKPNRAKSLGKAGTTQTKTSGPATAPSPLTEEKAALPEASAGSPERGPTLEEEPPGPEPRIGALGVKVFRSRIACLPGGRDRAGRPLLLVSTTEGAWEAPWCTVSEVTKLLSYLCTIPRPEDKAKGLAVLIDARRQPPQPGLVSALQATQAQVPASIRAILFLGEKEAALQLQTLPDVQVEVLTSLKALSHHVDPSQLPAVLEGPFPYCHTEWVHFFQKLDPFLADLHQASSLLQASIEEFEKADPPGGMQEATRCLSKSKELMEAVLRDPGLLGLQREGGATLARLQHDASRLDFSPDVRSHLAAATALYSLVDEQLHVLVTASNSLLGKLELRVRLGRLEAAIHQVSDWMEQEGRRCLQSLTPKDGSLETVEKAHAEFENFFLQAAAQYRRGLELSKQAAQLGATARGAGEAERAEFPELAAFASTQRAFQAELTHFYMAAERQRTDLETLLHLHRFCKRMTWFHMDCQDLMAQLRLDKTSRVSPGDQRRLHRYLQRLASEFPAEKLAAVGLQVASLSRAGLGQELWEEARIRHEEIRMLLEKALTHSSCPEAPAAHSARPERRGVAAKGQGVSVEVTSKGRWDQPPLDSLGMDHLPKSYWPPGPPRGEQNRTFQAGSPPQEAGQAAEAEDGKGSHKLPDPAREHLLATTFFRQQPPRQSQVPRLTGGSFSSEGTDSQTSLEDSPQTSPLASL

SEQ ID NO: 841424 - protein, 255 aa, Homo sapiens
MAAERQRTDLETLLHLHRFCKRMTWFHMDCQDLMAQLRLDKTSRVSPGDQRRLHRYLQRLASEFPAEKLAAVGLQVASLSRAGLGQELWEEARIRHEEIRMLLEKALTHSSCPEAPAAHSARPERRGVAAKGQGVSVEVTSKGRWDQPPLDSLGMDHLPKSYWPPGPPRGEQNRTFQAGSPPQEAGQAAEAEDGKGSHKLPDPAREHLLATTFFRQQPPRQSQVPRLTGGSFSSEGTDSQTSLEDSPQTSPLASL

SEQ ID NO: 841425 - protein, 255 aa, Homo sapiens; identical to SEQ ID NO: 841424

SEQ ID NO: 841426 - protein, 1001 aa, Homo sapiens
PPRPLLRDDAGVGAPGLPYPLAPGLGGTEGCPRQTDPRTHRPRAQERSRAARRWQPVTMDPPSLDTAIQHALAGLYPPFEATAPTVLGQVFRLLDSGFQGDGLSFLLDFLIPAKRLCEQVREAACAPYSHCLFLHEGWPLCLRDEVVVHLAPLNPLLLRQGDFYLQVEPQEEQSVCIMIKCLSLDLCTVDKKPVPEPAYPILFTQEWLEAINSDFEGNPLHNCLVASENGIAPVPWTKITSPEFVDDRPQVVNALCQAWGPLPLEALDLSSPQELHQASSPDNQVLPAQSLAKGKGRTYGSKYPGLIKVEQARCGEVAFRMDEVVSQDFEGDYVALLGFSQESRGESPSREAGTSSGCTSGALEEIAGTKETPLFQKILPLSEANEGPSLGNRACTKPESSEERPYNLGFRRKVNLKAPTHNSERPPQGSYMNVLEDALDCASGLRAGVSQEPAASKMQGPLGNPENMVQLRPGPRQASSPRLSPASPAAAASETKIEVKTKERNGRLPKPMPCPSRNTSSPEPPTPGLKFSFLRGQRQPSVTPEKASLQHNGPWKVLCSLYSPKPNRAKSLGKAGTTQTKTSGPATAPSPLTEEKAALPEASAGSPERGPTLEEEPPGPEPRIGALGVKVFRSRIACLPGGRDRAGRPLLLVSTTEGAWEAPWCTVSEVTKLLSYLCTIPRPEDKAKGLAVLIDARRQPPQPGLVSALQATQAQVPASIRAILFLGEKEAALQLQTLPDVQVEVLTSLKALSHHVDPSQLPAVLEGPFPYCHTEWVHFFQKLDPFLADLHQASSLLQASIEEFEKADPPGGMQEATRCLSKSKELMEAVLRDPGLLGLQREGGATLARLQHDASRLDFSPDVRSHLAAATALYSLVDEQLHVLVTASNSLLGKLELRVRLGRLEAAIHQVSDWMEQEGRRCLQSLTPKDGSLETVEKAHAEFENFFLQAAVRSRQQRSRTGADGEGVRGGGTARAKLWRWERARKVPETVREPAWIAEFS

SEQ ID NO: 841427 - protein, 675 aa, Homo sapiens
PPRPLLRDDAGVGAPGLPYPLAPGLGGTEGCPRQTDPRTHRPRAQERSRAARRWQPVTMDPPSLDTAIQHALAGLYPPFEATAPTVLGQVFRLLDSGFQGDGLSFLLDFLIPAKRLCEQVREAACAPYSHCLFLHEGWPLCLRDEVVVHLAPLNPLLLRQGDFYLQVEPQEEQSVCIMIKCLSLDLCTVDKKPVPEPAYPILFTQEWLEAINSDFEGNPLHNCLVASENGIAPVPWTKITSPEFVDDRPQVVNALCQAWGPLPLEALDLSSPQELHQASSPDNQVLPAQSLAKGKGRTYGSKYPGLIKVEQARCGEVAFRMDEVVSQDFEGDYVALLGFSQESRGESPSREAGTSSGCTSGALEEIAGTKETPLFQKILPLSEANEGPSLGNRACTKPESSEERPYNLGFRRKVNLKAPTHNSERPPQGSYMNVLEDALDCASGLRAGVSQEPAASKMQGPLGNPENMVQLRPGPRQASSPRLSPASPAAAASETKIEVKTKERNGRLPKPMPCPSRNTSSPEPPTPGLKFSFLRGQRQPSVTPEKASLQHNGPWKVLCSLYSPKPNRAKSLGKAGTTQTKTSGPATAPSPLTEEKAALPEASAGSPERGPTLEEEPPGPEPRIGALGVKVFRSRIACLPGSRGFKQEVVGRELGAPEHLQLLLGGGEAGNALEA

SEQ ID NO: 841428 - protein, 1001 aa, Homo sapiens; identical to SEQ ID NO: 841426

SEQ ID NO: 841429 - protein, 654 aa, Homo sapiens
PPRPLLRDDAGVGAPGLPYPLAPGLGGTEGCPRQTDPRTHRPRAQERSRAARRWQPVTMDPPSLDTAIQHALAGLYPPFEATAPTVLGQVFRLLDSGFQGDGLSFLLDFLIPAKRLCEQVREAACAPYSHCLFLHEGWPLCLRDEVVVHLAPLNPLLLRQGDFYLQVEPQEEQSVCIMIKCLSLDLCTVDKKPVPEPAYPILFTQEWLEAINSDFEGNPLHNCLVASENGIAPVPWTKITSPEFVDDRPQVVNALCQAWGPLPLEALDLSSPQELHQASSPDNQVLPAQSLAKGKGRTYGSKYPGLIKVEQARCGEVAFRMDEVVSQDFEGDYVALLGFSQESRGESPSREAGTSSGCTSGALEEIAGTKETPLFQKILPLSEANEGPSLGNRACTKPESSEERPYNLGFRRKVNLKAPTHNSERPPQGSYMNVLEDALDCASGLRAGVSQEPAASKMQGPLGNPENMVQLRPGPRQASSPRLSPASPAAAASETKIEVKTKERNGRLPKPMPCPSRNTSSPEPPTPGLKFSFLRGQRQPSVTPEKASLQHNGPWKVLCSLYSPKPNRAKSLGKAGTTQTKTSGPATAPSPLTEEKAALPEASAGSPERGPTLEEEPPGPEPRIGALGVKVFRSRIACLPGSSFLFGSGPFPSG

SEQ ID NO: 841430 - protein, 1167 aa, Homo sapiens
FYKKLCLLPVLEFPGSGKAGAEVLSVSSSFVSSMDVLAEEFGNLTPEQLAAPIPTVEEKWRLLPAFLKVKGLVKQHIDSFNYFINVEIKKIMKANEKVTSDADPMWYLKYLNIYVGLPDVEESFNVTRPVSPHECRLRDMTYSAPITVDIEYTRGSQRIIRNALPIGRMPIMLRSSNCVLTGKTPAEFAKLNECPLDPGGYFIVKGVEKVILIQEQLSKNRIIVEADRKGAVGASVTSSTHEKKSRTNMAVKQGRFYLRHNTLSEDIPIVIIFKAMGVESDQEIVQMIGTEEHVMAAFGPSLEECQKAQIFTQMQALKYIGNKVRRQRMWGGGPKKTKIEEARELLASTILTHVPVKEFNFRAKCIYTAVMVRRVILAQGDNKVDDRDYYGNKRLELAGQLLSLLFEDLFKKFNSEMKKIADQVIPKQRAAQFDVVKHMRQDQITNGMVNAISTGNWSLKRFKMDRQGVTQVLSRLSYISALGMMTRISSQFEKTRKVSGPRSLQPSQWGMLCPSDTPEGEACGLVKNLALMTHITTDMEDGPIVKLASNLGVEDVNLLCGEELSYPNVFLVFLNGNILGVIRDHKKLVNTFRLMRRAGYINEFVSISTNLTDRCVYISSDGGRLCRPYIIVKKQKPAVTNKHMEELAQGYRLNFEDFLHESLVEYLDVNEENDCNIALYEHTINKDTTHLEIEPFTLLGVCAGLIPYPHHNQSPRNTYQCAMGKQAMGTIGYNQRNRIDTLMYLLAYPQKPMVKTKTIELIEFEKLPAGQNATVAVMSYSGYDIEDALVLNKASLDRGFGRCLVYKNAKCTLKRYTNQTFDKVMGPMLDAATRKPIWRHEILDADGICSPGEKVENKQVLVNKSMPTVTQIPLEGSNVPQQPQYKDVPITYKGATDSYIEKVMISSNAEDAFLIKMLLRQTRRPEIGDKFSSRHGQKGVCGLIVPQEDMPFCDSGICPDIIMNPHGFPSRMTVGKLIELLAGKAGVLDGRFHYGTAFGGSKVKDVCEDLVRHGYNYLGKDYVTSGITGEPLEAYIYFGPVYYQKLKHMVLDKMHARARGPRAVLTRQPTEGRSRDGGLRLGEMERDCLIGYGASMLLLERLMISSDAFEVDVCGQCGLLGYSGWCHYCKSSCHVSSLRIPYACKLLFQELQSMNIIPRLKLSKYNE

SEQ ID NO: 841431 - protein, 648 aa, Homo sapiens
MDVLAEEFGNLTPEQLAAPIPTVEEKWRLLPAFLKVKGLVKQHIDSFNYFINVEIKKIMKANEKVTSDADPMWYLKYLNIYVGLPDVEESFNVTRPVSPHECRLRDMTYSAPITVDIEYTRGSQRIIRNALPIGRMPIMLRSSNCVLTGKTPAEFAKLNECPLDPGGYFIVKGVEKVILIQEQLSKNRIIVEADRKGAVGASVTSSTHEKKSRTNMAVKQGRFYLRHNTLSEDIPIVIIFKAMGVESDQEIVQMIGTEEHVMAAFGPSLEECQKAQIFTQMQALKYIGNKVRRQRMWGGGPKKTKIEEARELLASTILTHVPVKEFNFRAKCIYTAVMVRRVILAQGDNKVDDRDYYGNKRLELAGQLLSLLFEDLFKKFNSEMKKIADQVIPKQRAAQFDVVKHMRQDQITNGMVNAISTGNWSLKRFKMDRQGVTQVLSRLSYISALGMMTRISSQFEKTRKVSGPRSLQPSQWGMLCPSDTPEGEACGLVKNLALMTHITTDMEDGPIVKLASNLGVEDVNLLCGEELSYPNVFLVFLNGNILGVIRDHKKLVNTFRLMRRAGYINEFVSISTNLTDRCVYISSDGGRLCRPYIIVKKQKPAVTNKHMEELAQGYRCAITASHPATCLPSVFRMPASCSSRNYSL

SEQ ID NO: 841432 - protein, 1133 aa, Homo sapiens
MDVLAEEFGNLTPEQLAAPIPTVEEKWRLLPAFLKVKGLVKQHIDSFNYFINVEIKKIMKANEKVTSDADPMWYLKYLNIYVGLPDVEESFNVTRPVSPHECRLRDMTYSAPITVDIEYTRGSQRIIRNALPIGRMPIMLRSSNCVLTGKTPAEFAKLNECPLDPGGYFIVKGVEKVILIQEQLSKNRIIVEADRKGAVGASVTSSTHEKKSRTNMAVKQGRFYLRHNTLSEDIPIVIIFKAMGVESDQEIVQMIGTEEHVMAAFGPSLEECQKAQIFTQMQALKYIGNKVRRQRMWGGGPKKTKIEEARELLASTILTHVPVKEFNFRAKCIYTAVMVRRVILAQGDNKVDDRDYYGNKRLELAGQLLSLLFEDLFKKFNSEMKKIADQVIPKQRAAQFDVVKHMRQDQITNGMVNAISTGNWSLKRFKMDRQGVTQVLSRLSYISALGMMTRISSQFEKTRKVSGPRSLQPSQWGMLCPSDTPEGEACGLVKNLALMTHITTDMEDGPIVKLASNLGVEDVNLLCGEELSYPNVFLVFLNGNILGVIRDHKKLVNTFRLMRRAGYINEFVSISTNLTDRCVYISSDGGRLCRPYIIVKKQKPAVTNKHMEELAQGYRNFEDFLHESLVEYLDVNEENDCNIALYEHTINKDTTHLEIEPFTLLGVCAGLIPYPHHNQSPRNTYQCAMGKQAMGTIGYNQRNRIDTLMYLLAYPQKPMVKTKTIELIEFEKLPAGQNATVAVMSYSGYDIEDALVLNKASLDRGFGRCLVYKNAKCTLKRYTNQTFDKVMGPMLDAATRKPIWRHEILDADGICSPGEKVENKQVLVNKSMPTVTQIPLEGSNVPQQPQYKDVPITYKGATDSYIEKVMISSNAEDAFLIKMLLRQTRRPEIGDKFSSRHGQKGVCGLIVPQEDMPFCDSGICPDIIMNPHGFPSRMTVGKLIELLAGKAGVLDGRFHYGTAFGGSKVKDVCEDLVRHGYNYLGKDYVTSGITGEPLEAYIYFGPVYYQKLKHMVLDKMHARARGPRAVLTRQPTEGRSRDGGLRLGEMERDCLIGYGASMLLLERLMISSDAFEVDVCGQCGLLGYSGWCHYCKSSCHVSSLRIPYACKLLFQELQSMNIIPRLKLSKYNE

SEQ ID NO: 841433 - protein, 1133 aa, Homo sapiens; identical to SEQ ID NO: 841432

SEQ ID NO: 841434 - protein, 120 aa, Homo sapiens [sequence omitted]

SEQ ID NO: 841435 - protein, 643 aa, Homo sapiens
MCGICCSVNFSAEHFSQDLKEDLLYNLKQRGPNSSKQLLKSDVNYQCLFSAHVLHLRGVLTTQPVEDERGNVFLWNGEIFSGIKVEAEENDTQILFNYLSSCKNESEILSLFSEVQGPWSFIYYQASSHYLWFGRDFFGRRSLLWHFSNLGKSFCLSSVGTQTSGLANQWQEVPASGLFRIDLKSTVISRCIILQLYPWKYISRENIIEENVNSLSQISADLPAFVSVVANEAKLYLEKPVVPLNMMLPQAALETHCSNISNVPPTREILQVFLTDVHMKEVIQQFIDVLSVAVKKRVLCLPRDENLTANEVLKTCDRKANVAILFSGGIDSMVIATLADRHIPLDEPIDLLNVAFIAEEKTMPTTFNREGNKQKNKCEIPSEEFSKDVAAAAADSPNKHVSVPDRITGRAGLKELQAVSPSRIWNFVEINVSMEELQKLRRTRICHLIRPLDTVLDDSIGCAVWFASRGIGWLVAQEGVKSYQSNAKVVLTGIGADEQLAGYSRHRVRFQSHGLEGLNKEIMMELGRISSRNLGRDDRVIGDHGKEARFPFLDENVVSFLNSLPIWEKANLTLPRGIGEKLLLRLAAVELGLTASALLPKRAMQFGSRIAKMEKINEKASDKCGRLQIMSLENLSIEKETKL

SEQ ID NO: 841436 - protein, 85 aa, Homo sapiens
AILRVLRSVEMPSRGTRPEDSSVLIPTDNSTPHKEDLSSKVSVRRDEKAPGLGTGRHWTLKVVRSGQRGACLGLGFALLLCSFYS

SEQ ID NO: 841437 - protein, 643 aa, Homo sapiens; identical to SEQ ID NO: 841435

SEQ ID NO: 841438 - protein, 643 aa, Homo sapiens; identical to SEQ ID NO: 841435

SEQ ID NO: 841439 - protein, 83 aa, Homo sapiens
GLMPIWALGVHLQHGCPLVLYIHQGPNVHLRPGVHLGSDVQLKTGCPPGAEESTQGLVLNWGLMTTRGQGTHQACCPPVTRCP

SEQ ID NO: 841440 - protein, 70 aa, Homo sapiens
SQNAPFLPLNAYLRLSPSKPNSNAISSKKGFFIMAESIPASTPPPRTLPATATYKKSLTINLLSTTYIPT

SEQ ID NO: 841441 - protein, 649 aa, Homo sapiens
RSLPRGRAHGRTERRKGWRCDSRAGALASPPRALAAGPGEMESTAYPLNLSLKEEEEEEEIQSRELEDGPADMQKVRICSEGGWVPALFDEVAIYFSDEEWEVLTEQQKALYREVMRMNYETVLSLEFPFPKPDMITRLEGEEESQNSDEWQLQGGTSAENEESDVKPPDWPNPMNATSQFPQPQHFDSFGLRLPRDITELPEWSEGYPFYMAMGFPGYDLSADDIAGKFQFSRGMRRSYDAGFKLMVVEYAESTNNCQAAKQFGVLEKNVRDWRKVKPQLQNAHAMRRAFRGPKNGRFALVDQRVAEYVRYMQAKGDPITREAMQLKALEIAQEMNIPEKGFKASLGWCRRMMRRYDLSLRHKVPVPQHLPEDLTEKLVTYQRSVLALRRAHDYEVAQMGNADETPICLEVPSRVTVDNQGEKPVLVKTPGREKLKITAMLGVLADGRKLPPYIILRGTYIPPGKFPSGMEIRCHRYGWMTEDLMQDWLEVVWRRRTGAVPKQRGMLILNGFRGHATDSVKNSMESMNTDMVIIPGGLTSQLQVLDVVVYKPLNDSVRAQYSNWLLAGNLALSPTGNAKKPPLGLFLEWVMVAWNSISSESIVQGFKKCHISSNLEEEDDVLWEIESELPGGGEPPKDCDTESMAESN

SEQ ID NO: 841442 - protein, 491 aa, Homo sapiens
MENEESDVKPPDWPNPMNATSQFPQPQHFDSFGLRLPRDITELPEWSEGYPFYMAMGFPGYDLSADDIAGKFQFSRGMRRSYDAGFKLMVVEYAESTNNCQAAKQFGVLEKNVRDWRKVKPQLQNAHAMRRAFRGPKNGRFALVDQRVAEYVRYMQAKGDPITREAMQLKALEIAQEMNIPEKGFKASLGWCRRMMRRYDLSLRHKVPVPQHLPEDLTEKLVTYQRSVLALRRAHDYEVAQMGNADETPICLEVPSRVTVDNQGEKPVLVKTPGREKLKITAMLGVLADGRKLPPYIILRGTYIPPGKFPSGMEIRCHRYGWMTEDLMQDWLEVVWRRRTGAVPKQRGMLILNGFRGHATDSVKNSMESMNTDMVIIPGGLTSQLQVLDVVVYKPLNDSVRAQYSNWLLAGNLALSPTGNAKKPPLGLFLEWVMVAWNSISSESIVQGFKKCHISSNLEEEDDVLWEIESELPGGGEPPKDCDTESMAESN

SEQ ID NO: 841443 - protein, 649 aa, Homo sapiens; identical to SEQ ID NO: 841441

SEQ ID NO: 841444 - protein, 649 aa, Homo sapiens; identical to SEQ ID NO: 841441

SEQ ID NO: 841445 - protein, 649 aa, Homo sapiens; identical to SEQ ID NO: 841441

SEQ ID NO: 841446 - protein, 711 aa, Homo sapiens
RSLPRGRAHGRTERRKGWRCDSRAGALASPPRALAAGPGEMESTAYPLNLSLKEEEEEEEIQSRELEDGPADMQKVRICSEGGWVPALFDEVAIYFSDEEWEVLTEQQKALYREVMRMNYETVLSLEFPFPKPDMITRLEGEEESQNSDEWQLQGGTSAENEESDVKPPDWPNPMNATSQFPQPQHFDSFGLRLPRDITELPEWSEGYPFYMAMGFPGYDLSADDIAGKFQFSRGMRRSYDAGFKLMVVEYAESTNNCQAAKQFGVLEKNVRDWRKVKPQLQNAHAMRRAFRGPKNGRFALVDQRVAEYVRYMQAKGDPITREAMQLKALEIAQEMNIPEKGFKASLGWCRRMMRRYDLSLRHKVPVPQHLPEDLTEKLVTYQRSVLALRRAHDYEVAQMGNADETPICLEVPSRVTVDNQGEKPVLVKTPGREKLKITAMLGVLADGRKLPPYIILRGTYIPPGKFPSGMEIRCHRYGWMTEDLMQDWLEVVWRRRTGAVPKQRGMLILNGFRGHATDSVKNSMESMNTDMVIIPGGLTSQLQVLDVVVYKPLNDSVRAQYSNWLLAGNLALSPTGNAKKPPLGLFLEWVMVAWNSISSESIVQGFKKCHISSNLEEEDDVHQKKPVNMKEQRLFPGEKTIYSTPTRDSSYGHNSGVLLWRKPQVKFYSAFENASKSRPCPHTGQDYREGFVEMCHLCTPATYTFPLLEK

SEQ ID NO: 841447 - protein, 649 aa, Homo sapiens; identical to SEQ ID NO: 841441

SEQ ID NO: 841448 - protein, 187 aa, Homo sapiens
RSLPRGRAHGRTERRKGWRCDSRAGALASPPRALAAGPGEMESTAYPLNLSLKEEEEEEEIQSRELEDGPADMQKVRICSEGGWVPALFDEVAIYFSDEEWEVLTEQQKALYREVMRMNYETVLSLEFPFPKPDMITRLEGEEESQNSDEWQLQGGTSAGTTSKAVQRPSSWEHCGVGFSVYIPRGI

SEQ ID NO: 841449 - protein, 2302 aa, Homo sapiens
ARGALNGVYVLCCLRGLSSDQSGLRVVISMGFVRQIQLLLWKNWTLRKRQKIRFVVELVWPLSLFLVLIWLRNANPLYSHHECHFPNKAMPSAGMLPWLQGIFCNVNNPCFQSPTPGESPGIVSNYNNSILARVYRDFQELLMNAPESQHLGRIWTELHILSQFMDTLRTHPERIAGRGIRIRDILKDEETLTLFLIKNIGLSDSVVYLLINSQVRPEQFAHGVPDLALKDIACSEALLERFIIFSQRRGAKTVRYALCSLSQGTLQWIEDTLYANVDFFKLFRVLPTLLDSRSQGINLRSWGGILSDMSPRIQEFIHRPSMQDLLWVTRPLMQNGGPETFTKLMGILSDLLCGYPEGGGSRVLSFNWYEDNNYKAFLGIDSTRKDPIYSYDRRTTSFCNALIQSLESNPLTKIAWRAAKPLLMGKILYTPDSPAARRILKNANSTFEELEHVRKLVKAWEEVGPQIWYFFDNSTQMNMIRDTLGNPTVKDFLNRQLGEEGITAEAILNFLYKGPRESQADDMANFDWRDIFNITDRTLRLVNQYLECLVLDKFESYNDETQLTQRALSLLEENMFWAGVVFPDMYPWTSSLPPHVKYKIRMDIDVVEKTNKIKDRYWDSGPRADPVEDFRYIWGGFAYLQDMVEQGITRSQVQAEAPVGIYLQQMPYPCFVDDSFMIILNRCFPIFMVLAWIYSVSMTVKSIVLEKELRLKETLKNQGVSNAVIWCTWFLDSFSIMSMSIFLLTIFIMHGRILHYSDPFILFLFLLAFSTATIMLCFLLSTFFSKASLAAACSGVIYFTLYLPHILCFAWQDRMTAELKKAVSLLSPVAFGFGTEYLVRFEEQGLGLQWSNIGNSPTEGDEFSFLLSMQMMLLDAAVYGLLAWYLDQVFPGDYGTPLPWYFLLQESYWLGGEGCSTREERALEKTEPLTEETEDPEHPEGIHDSFFEREHPGWVPGVCVKNLVKIFEPCGRPAVDRLNITFYENQITAFLGHNGAGKTTTLSILTGLLPPTSGTVLVGGRDIETSLDAVRQSLGMCPQHNILFHHLTVAEHMLFYAQLKGKSQEEAQLEMEAMLEDTGLHHKRNEEAQDLSGGMQRKLSVAIAFVGDAKVVILDEPTSGVDPYSRRSIWDLLLKYRSGRTIIMSTHHMDEADLLGDRIAIIAQGRLYCSGTPLFLKNCFGTGLYLTLVRKMKNIQSQRKGSEGTCSCSSKGFSTTCPAHVDDLTPEQVLDGDVNELMDVVLHHVPEAKLVECIGQELIFLLPNKNFKHRAYASLFRELEETLADLGLSSFGISDTPLEEIFLKVTEDSDSGPLFAGGAQQKRENVNPRHPCLGPREKAGQTPQDSNVCSPGAPAAHPEGQPPPEPECPGPQLNTGTQLVLQHVQALLVKRFQHTIRSHKDFLAQIVLPATFVFLALMLSIVIPPFGEYPALTLHPWIYGQQYTFFSMDEPGSEQFTVLADVLLNKPGFGNRCLKEGWLPEYPCGNSTPWKTPSVSPNITQLFQKQKWTQVNPSPSCRCSTREKLTMLPECPEGAGGLPPPQRTQRSTEILQDLTDRNISDFLVKTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECFGLLGVNGAGKTTTFKMLTGDTTVTSGDATVAGKSILTNISEVHQNMGYCPQFDAIDELLTGREHLYLYARLRGVPAEEIEKVANWSIKSLGLTVYADCLAGTYSGGNKRKLSTAIALIGCPPLVLLDEPTTGMDPQARRMLWNVIVSIIREGRAVVLTSHSMEECEALCTRLAIMVKGAFRCMGTIQHLKSKFGDGYIVTMKIKSPKDDLLPDLNPVEQFFQGNFPGSVQRERHYNMLQFQVSSSSLARIFQLLLSHKDSLLIEEYSVTQTTLDQVFVNFAKQQTESHDLPLHPRAAGASRQAQD

SEQ ID NO: 841450 - protein, 1752 aa, Homo sapiens
ARGALNGVYVLCCLRGLSSDQSGLRVVISMGFVRQIQLLLWKNWTLRKRQKIRFVVELVWPLSLFLVLIWLRNANPLYSHHECHFPNKAMPSAGMLPWLQGIFCNVNNPCFQSPTPGESPGIVSNYNNSILARVYRDFQELLMNAPESQHLGRIWTELHILSQFMDTLRTHPERIAGRGIRIRDILKDEETLTLFLIKNIGLSDSVVYLLINSQVRPEQFAHGVPDLALKDIACSEALLERFIIFSQRRGAKTVRYALCSLSQGTLQWIEDTLYANVDFFKLFRVLPTLLDSRSQGINLRSWGGILSDMSPRIQEFIHRPSMQDLLWVTRPLMQNGGPETFTKLMGILSDLLCGYPEGGGSRVLSFNWYEDNNYKAFLGIDSTRKDPIYSYDRRTTSFCNALIQSLESNPLTKIAWRAAKPLLMGKILYTPDSPAARRILKNANSTFEELEHVRKLVKAWEEVGPQIWYFFDNSTQMNMIRDTLGNPTVKDFLNRQLGEEGITAEAILNFLYKGPRESQADDMANFDWRDIFNITDRTLRLVNQYLECLVLDKFESYNDETQLTQRALSLLEENMFWAGVVFPDMYPWTSSLPPHVKYKIRMDIDVVEKTNKIKDRYWDSGPRADPVEDFRYIWGGFAYLQDMVEQGITRSQVQAEAPVGIYLQQMPYPCFVDDSFMIILNRCFPIFMVLAWIYSVSMTVKSIVLEKELRLKETLKNQGVSNAVIWCTWFLDSFSIMSMSIFLLTIFIMHGRILHYSDPFILFLFLLAFSTATIMLCFLLSTFFSKASLAAACSGVIYFTLYLPHILCFAWQDRMTAELKKAVSLLSPVAFGFGTEYLVRFEEQGLGLQWSNIGNSPTEGDEFSFLLSMQMMLLDAAVYGLLAWYLDQVFPGDYGTPLPWYFLLQESYWLGGEGCSTREERALEKTEPLTEETEDPEHPEGIHDSFFEREHPGWVPGVCVKNLVKIFEPCGRPAVDRLNITFYENQITAFLGHNGAGKTTTLSILTGLLPPTSGTTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECFGLLGVNGAGKTTTFKMLTGDTTVTSGDATVAGKSILTNISEVHQNMGYCPQFDAIDELLTGREHLYLYARLRGVPAEEIEKVANWSIKSLGLTVYADCLAGTYSGGNKRKLSTAIALIGCPPLVLLDEPTTGMDPQARRMLWNVIVSIIREGRAVVLTSHSMEECEALCTRLAIMVKGAFRCMGTIQHLKSKFGDGYIVTMKIKSPKDDLLPDLNPVEQFFQGNFPGSVQRERHYNMLQFQVSSSSLARIFQLLLSHKDSLLIEEYSVTQTTLDQVFVNFAKQQTESHDLPLHPRAAGASRQAQD

SEQ ID NO: 841451 - protein, 771 aa, Homo sapiens
ARRETGRGVWQRTQRSTEILQDLTDRNISDFLVKTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECFGLLGVNGAGKTTTFKMLTGDTTVTSGDATVAGKSILTNISEVHQNMGYCPQFDAIDELLTGREHLYLYARLRGVPAEEIEKVANWSIKSLGLTVYADCLAGTYSGGNKRKLSTAIALIGCPPLVLLDEPTTGMDPQARRMLWNVIVSIIREGRAVVLTSHSMEECEALCTRLAIMVKGAFRCMGTIQHLKSKFGDGYIVTMKIKSPKDDLLPDLNPVEQFFQGNFPGSVQRERHYNMLQFQVSSSSLARIFQLLLSHKDSLLIEEYSVTQTTLDQVFVNFAKQQTESHDLPLHPRAAGASRQAQD

SEQ ID NO: 841452 - protein, 1689 aa, Homo sapiens
ARGALNGVYVLCCLRGLSSDQSGLRVVISMGFVRQIQLLLWKNWTLRKRQKIRFVVELVWPLSLFLVLIWLRNANPLYSHHECHFPNKAMPSAGMLPWLQGIFCNVNNPCFQSPTPGESPGIVSNYNNSILARVYRDFQELLMNAPESQHLGRIWTELHILSQFMDTLRTHPERIAGRGIRIRDILKDEETLTLFLIKNIGLSDSVVYLLINSQVRPEQFAHGVPDLALKDIACSEALLERFIIFSQRRGAKTVRYALCSLSQGTLQWIEDTLYANVDFFKLFRVLPTLLDSRSQGINLRSWGGILSDMSPRIQEFIHRPSMQDLLWVTRPLMQNGGPETFTKLMGILSDLLCGYPEGGGSRVLSFNWYEDNNYKAFLGIDSTRKDPIYSYDRRTTSFCNALIQSLESNPLTKIAWRAAKPLLMGKILYTPDSPAARRILKNANSTFEELEHVRKLVKAWEEVGPQIWYFFDNSTQMNMIRDTLGNPTVKDFLNRQLGEEGITAEAILNFLYKGPRESQADDMANFDWRDIFNITDRTLRLVNQYLECLVLDKFESYNDETQLTQRALSLLEENMFWAGVVFPDMYPWTSSLPPHVKYKIRMDIDVVEKTNKIKDRYWDSGPRADPVEDFRYIWGGFAYLQDMVEQGITRSQVQAEAPVGIYLQQMPYPCFVDDSFMIILNRCFPIFMVLAWIYSVSMTVKSIVLEKELRLKETLKNQGVSNAVIWCTWFLDSFSIMSMSIFLLTIFIMHGRILHYSDPFILFLFLLAFSTATIMLCFLLSTFFSKASLAAACSGVIYFTLYLPHILCFAWQDRMTAELKKAVSLLSPVAFGFGTEYLVRFEEQGLGLQWSNIGNSPTEGDEFSFLLSMQMMLLDAAVYGLLAWYLDQVFPGDYGTPLPWYFLLQESYWLGGEGCSTREERALEKTEPLTEETEDPEHPEGIHDSFFEREHPGWVPGVCVKNLVKIFEPCGRPAVDRLNITFYENQITAFLGHNGAGKTTTLSILTGLLPPTSGTTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECFGLLGVNGAGKTTTFKMLTGDTTVTSGDATVAGKSILTNISEVHQNMGYCPQFDAIDELLTGREHLYLYARLRGVPAEEIEKVANWSIKSLGLTVYADCLAGTYSGGNKRKLSTAIALIGCPPLVLLVTAGLGRTKGLNQVLGLLGWGNRFWVGRFRNCSSLALVWTVSCVAHFERSAQCLVHTAPEKNKSRHSLDLGLRTSCVPRMSPVGPSAHSREVQPTLRPVGVWSPYRSTELGQRLLS

SEQ ID NO: 841453 - protein, 1601 aa, Homo sapiens
ARGALNGVYVLCCLRGLSSDQSGLRVVISMGFVRQIQLLLWKNWTLRKRQKIRFVVELVWPLSLFLVLIWLRNANPLYSHHECHFPNKAMPSAGMLPWLQGIFCNVNNPCFQSPTPGESPGIVSNYNNSILARVYRDFQELLMNAPESQHLGRIWTELHILSQFMDTLRTHPERIAGRGIRIRDILKDEETLTLFLIKNIGLSDSVVYLLINSQVRPEQFAHGVPDLALKDIACSEALLERFIIFSQRRGAKTVRYALCSLSQGTLQWIEDTLYANVDFFKLFRVLPTLLDSRSQGINLRSWGGILSDMSPRIQEFIHRPSMQDLLWVTRPLMQNGGPETFTKLMGILSDLLCGYPEGGGSRVLSFNWYEDNNYKAFLGIDSTRKDPIYSYDRRTTSFCNALIQSLESNPLTKIAWRAAKPLLMGKILYTPDSPAARRILKNANSTFEELEHVRKLVKAWEEVGPQIWYFFDNSTQMNMIRDTLGNPTVKDFLNRQLGEEGITAEAILNFLYKGPRESQADDMANFDWRDIFNITDRTLRLVNQYLECLVLDKFESYNDETQLTQRALSLLEENMFWAGVVFPDMYPWTSSLPPHVKYKIRMDIDVVEKTNKIKDRYWDSGPRADPVEDFRYIWGGFAYLQDMVEQGITRSQVQAEAPVGIYLQQMPYPCFVDDSFMIILNRCFPIFMVLAWIYSVSMTVKSIVLEKELRLKETLKNQGVSNAVIWCTWFLDSFSIMSMSIFLLTIFIMHGRILHYSDPFILFLFLLAFSTATIMLCFLLSTFFSKASLAAACSGVIYFTLYLPHILCFAWQDRMTAELKKAVSLLSPVAFGFGTEYLVRFEEQGLGLQWSNIGNSPTEGDEFSFLLSMQMMLLDAAVYGLLAWYLDQVFPGDYGTPLPWYFLLQESYWLGGEGCSTREERALEKTEPLTEETEDPEHPEGIHDSFFEREHPGWVPGVCVKNLVKIFEPCGRPAVDRLNITFYENQITAFLGHNGAGKTTTLSILTGLLPPTSGTTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECFGLLGVNGAGKTTTFKMLTGDTTVTSGDATVAGKSILTNISEVHQNMGYCPQFDAIDELLTGREHLYLYARLRGVPAEEIEKVANWSIKSLGLTVYADCLAGTYSGGNKRKLSTAIALIGCPPLVLLVSHQRVGPRNAILTHRKITGGVPNPRME

SEQ ID NO: 841454 - protein, 1216 aa, Homo sapiens
ARGALNGVYVLCCLRGLSSDQSGLRVVISMGFVRQIQLLLWKNWTLRKRQKIRFVVELVWPLSLFLVLIWLRNANPLYSHHECHFPNKAMPSAGMLPWLQGIFCNVNNPCFQSPTPGESPGIVSNYNNSILARVYRDFQELLMNAPESQHLGRIWTELHILSQFMDTLRTHPERIAGRGIRIRDILKDEETLTLFLIKNIGLSDSVVYLLINSQVRPEQFAHGVPDLALKDIACSEALLERFIIFSQRRGAKTVRYALCSLSQGTLQWIEDTLYANVDFFKLFRVLPTLLDSRSQGINLRSWGGILSDMSPRIQEFIHRPSMQDLLWVTRPLMQNGGPETFTKLMGILSDLLCGYPEGGGSRVLSFNWYEDNNYKAFLGIDSTRKDPIYSYDRRTTSFCNALIQSLESNPLTKIAWRAAKPLLMGKILYTPDSPAARRILKNANSTFEELEHVRKLVKAWEEVGPQIWYFFDNSTQMNMIRDTLGNPTVKDFLNRQLGEEGITAEAILNFLYKGPRESQADDMANFDWRDIFNITDRTLRLVNQYLECLVLDKFESYNDETQLTQRALSLLEENMFWAGVVFPDMYPWTSSLPPHVKYKIRMDIDVVEKTNKIKDRYWDSGPRADPVEDFRYIWGGFAYLQDMVEQGITRSQVQAEAPVGIYLQQMPYPCFVDDSFMIILNRCFPIFMVLAWIYSVSMTVKSIVLEKELRLKETLKNQGVSNAVIWCTWFLDSFSIMSMSIFLLTIFIMHGRILHYSDPFILFLFLLAFSTATIMLCFLLSTFFSKASLAAACSGVIYFTLYLPHILCFAWQDRMTAELKKAVSLLSPVAFGFGTEYLVRFEEQGLGLQWSNIGNSPTEGDEFSFLLSMQMMLLDAAVYGLLAWYLDQVFPGDYGTPLPWYFLLQESYWLGGEGCSTREERALEKTEPLTEETEDPEHPEGIHDSFFEREHPGWVPGVCVKNLVKIFEPCGRPAVDRLNITFYENQITAFLGHNGAGKTTTLSILTGLLPPTSGTTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIVSVSL

SEQ ID NO: 841455 - protein, 84 aa, Homo sapiens
YIQTYCRWNGMWNSITLSCLISHRWAVIPMMYPASFLFDVPSTAYVALSCANLFIGINSSAITFILELFENNRVSITFLAFLFD

SEQ ID NO: 841456 - protein, 103 aa, Homo sapiens
RVKFTRKSFQCIKSILFASFMIILNRCFPIFMVLAWIYSVSMTVKSIVLEKELRLKETLKNQGVSNAVIWCTWFLDSFSIMSMSIFLLTIFIMEVLYHTRQCV

SEQ ID NO: 841457 - protein, 1639 aa, Homo sapiens
ARGALNGVYVLCCLRGLSSDQSGLRVVISMGFVRQIQLLLWKNWTLRKRQKIRFVVELVWPLSLFLVLIWLRNANPLYSHHECHFPNKAMPSAGMLPWLQGIFCNVNNPCFQSPTPGESPGIVSNYNNSILARVYRDFQELLMNAPESQHLGRIWTELHILSQFMDTLRTHPERIAGRGIRIRDILKDEETLTLFLIKNIGLSDSVVYLLINSQVRPEQFAHGVPDLALKDIACSEALLERFIIFSQRRGAKTVRYALCSLSQGTLQWIEDTLYANVDFFKLFRVLPTLLDSRSQGINLRSWGGILSDMSPRIQEFIHRPSMQDLLWVTRPLMQNGGPETFTKLMGILSDLLCGYPEGGGSRVLSFNWYEDNNYKAFLGIDSTRKDPIYSYDRRTTSFCNALIQSLESNPLTKIAWRAAKPLLMGKILYTPDSPAARRILKNANSTFEELEHVRKLVKAWEEVGPQIWYFFDNSTQMNMIRDTLGNPTVKDFLNRQLGEEGITAEAILNFLYKGPRESQADDMANFDWRDIFNITDRTLRLVNQYLECLVLDKFESYNDETQLTQRALSLLEENMFWAGVVFPDMYPWTSSLPPHVKYKIRMDIDVVEKTNKIKDRYWDSGPRADPVEDFRYIWGGFAYLQDMVEQGITRSQVQAEAPVGIYLQQMPYPCFVDDSFMIILNRCFPIFMVLAWIYSVSMTVKSIVLEKELRLKETLKNQGVSNAVIWCTWFLDSFSIMSMSIFLLTIFIMHGRILHYSDPFILFLFLLAFSTATIMLCFLLSTFFSKASLAAACSGVIYFTLYLPHILCFAWQDRMTAELKKAVSLLSPVAFGFGTEYLVRFEEQGLGLQWSNIGNSPTEGDEFSFLLSMQMMLLDAAVYGLLAWYLDQVFPGDYGTPLPWYFLLQESYWLGGEGCSTREERALEKTEPLTEETEDPEHPEGIHDSFFEREHPGWVPGVCVKNLVKIFEPCGRPAVDRLNITFYENQITAFLGHNGAGKTTTLSILTGLLPPTSGTTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECFGLLGVNGAGKTTTFKMLTGDTTVTSGDATVAGKSILTNISEVHQNMGYCPQFDAIDELLTGREHLYLYARLRGVPAEEIEKVANWSIKSLGLTVYADCLAGTYSGGNKRKLSTAIALIGCPPLVLLDEPTTGMDPQARRMLWNVIVSIIREGRAVVLTSHSMEECEALCTRLAIMVKGAFRCMGTIQMDWPA

SEQ ID NO: 841458 - protein, 584 aa, Homo sapiens
MSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECFGLLGVNGAGKTTTFKMLTGDTTVTSGDATVAGKSILTNISEVHQNMGYCPQFDAIDELLTGREHLYLYARLRGVPAEEIEKVANWSIKSLGLTVYADCLAGTYSGGNKRKLSTAIALIGCPPLVLLDEPTTGMDPQARRMLWNVIVSIIREGRAVVLTSHSMEECEALCTRLAIMVKGAFRCMGTIQHLKSKFGDGYIVTMKIKSPKDDLLPDLNPVEQFFQGNFPGSVQRERHYNMLQFQVSSSSLARIFQLLLSHKDSLLIEEYSVTQTTLDQVFVNFAKQQTESHDLPLHPRAAGASRQAQD

SEQ ID NO: 841459 - protein, 1547 aa, Homo sapiens
ARGALNGVYVLCCLRGLSSDQSGLRVVISMGFVRQIQLLLWKNWTLRKRQKIRFVVELVWPLSLFLVLIWLRNANPLYSHHECHFPNKAMPSAGMLPWLQGIFCNVNNPCFQSPTPGESPGIVSNYNNSILARVYRDFQELLMNAPESQHLGRIWTELHILSQFMDTLRTHPERIAGRGIRIRDILKDEETLTLFLIKNIGLSDSVVYLLINSQVRPEQFAHGVPDLALKDIACSEALLERFIIFSQRRGAKTVRYALCSLSQGTLQWIEDTLYANVDFFKLFRVLPTLLDSRSQGINLRSWGGILSDMSPRIQEFIHRPSMQDLLWVTRPLMQNGGPETFTKLMGILSDLLCGYPEGGGSRVLSFNWYEDNNYKAFLGIDSTRKDPIYSYDRRTTSFCNALIQSLESNPLTKIAWRAAKPLLMGKILYTPDSPAARRILKNANSTFEELEHVRKLVKAWEEVGPQIWYFFDNSTQMNMIRDTLGNPTVKDFLNRQLGEEGITAEAILNFLYKGPRESQADDMANFDWRDIFNITDRTLRLVNQYLECLVLDKFESYNDETQLTQRALSLLEENMFWAGVVFPDMYPWTSSLPPHVKYKIRMDIDVVEKTNKIKDRYWDSGPRADPVEDFRYIWGGFAYLQDMVEQGITRSQVQAEAPVGIYLQQMPYPCFVDDSFMIILNRCFPIFMVLAWIYSVSMTVKSIVLEKELRLKETLKNQGVSNAVIWCTWFLDSFSIMSMSIFLLTIFIMHGRILHYSDPFILFLFLLAFSTATIMLCFLLSTFFSKASLAAACSGVIYFTLYLPHILCFAWQDRMTAELKKAVSLLSPVAFGFGTEYLVRFEEQGLGLQWSNIGNSPTEGDEFSFLLSMQMMLLDAAVYGLLAWYLDQVFPGDYGTPLPWYFLLQESYWLGGEGCSTREERALEKTEPLTEETEDPEHPEGIHDSFFEREHPGWVPGVCVKNLVKIFEPCGRPAVDRLNITFYENQITAFLGHNGAGKTTTLSILTGLLPPTSGTTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECFGLLGVNGAGKTTTFKMLTGDTTVTSGDATVAGKSILTNISEVHQNMGYCPQFDAIDELLTGREHLYLYARLRGVPAEEIEKVKNVLLWPHRSLVNYKPVS

SEQ ID NO: 841460 - protein, 56 aa, Homo sapiens
MPLALGLSLPHPPQPLNSPVLLVPPGGMQRKLSVAIAFVGDAKVVILDEPTSGVDP

SEQ ID NO: 841461 - protein, 140 aa, Homo sapiens
MSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRAT

SEQ ID NO: 841462 - protein, 30 aa, Homo sapiens
MQSKILIMERKQLGGGKTWRREVGKTETMK

SEQ ID NO: 841463 - protein, 52 aa, Homo sapiens
VVHGVAWLGGPKNSMAKLLQILLHACSFLFALFLLSSPSFLSFFLSFFLSFF

SEQ ID NO: 841464 - protein, 119 aa, Homo sapiens
MDRKSHKGAGKLGLPHRNLAKERHSWPAAAGGASARSHVANPMATNKGHCPSKAAPPAQKMESGSWLGGLHLGRTCPAKSCESLMSIRTSSPNFLQQPLILPSPCGPAHPALLDSPPGI

SEQ ID NO: 841465 - protein, 219 aa, Homo sapiens
MSEQEAQAPGGRGLPPDMLAEQVELWWSQQPRRSALCFVVAVGLVAGCGAGGVALLSTTSSRSGEWRLATGTVLCLLALLVLVKQLMSSAVQDMNCIRQAHHVALLRSGGGADALVVLLSGLVLLVTGLTLAGLAAAPAPARPLAAMLSVGIALAALGSLLLLGLLLYQVGVSGHCPSICMATPSTHSGHGGHGSIFSISGQLSAGRRHETTSSIASLI

SEQ ID NO: 841466 - protein, 219 aa, Homo sapiens; identical to SEQ ID NO: 841465

SEQ ID NO: 841467 - protein, 219 aa, Homo sapiens; identical to SEQ ID NO: 841465

SEQ ID NO: 841468 - protein, 219 aa, Homo sapiens; identical to SEQ ID NO: 841465

SEQ ID NO: 841469 - protein, 219 aa, Homo sapiens; identical to SEQ ID NO: 841465

SEQ ID NO: 841470 - protein, 219 aa, Homo sapiens; identical to SEQ ID NO: 841465

SEQ ID NO: 841471 - protein, 174 aa, Homo sapiens
MSEQEAQAPGGRGLPPDMLAEQVELWWSQQPRRSALCFVVAVGLVAGCGAGGVALLSTTSSRSGEWRLATGTVLCLLALLVLVKQLMSSAVQDMNCIRQAHHVALLRSGGGADALVVLLSGLVRVTGLTGGGAPCLSACACVGLSAAGRGVARVGVRSLLCDLPGGAASSNCGG

SEQ ID NO: 841472 - protein, 111 aa, Homo sapiens [sequence omitted]

SEQ ID NO: 841473 - protein, 830 aa, Homo sapiens
SGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGASETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPAAPKPAVKSSSSQPVTPVSPVWSPGVAPTQPPAFPTSNPSKGTVVSSIKIAQPSYPPARPASTLNVAGPFKGPQAAVASQNYTPKPTVSTPTVNAVQPGAVGPSNELPGMSGRGAQLFAKRQSRMEKYVVDSDTVQAHAARAQSPTPSLPASWKYSSNVRAPPPVAYNPIHSPSYPLAALKSQPSAAQPSKMGKKKGKKPLNALDVMKHQPYQLNASLFTFQPPDAKDGLPQKSSVKVNSALAMKQALPPRPVNAASPTNVQASSVYSVPAYTSPPSFFAEASSPVSASPVPVGIPTSPKQESASSSYFVAPRPKFSAKKSGVTIQVWKPSVVEE

SEQ ID NO: 841474 - protein, 86 aa, Homo sapiens
SGRELRVIQESEAGDAGLPRVEVILDCSDRQKTEGCRLQAGHRYYVTFEDRTQPAGPLVFIGSKRRHLLFNCTLSAASFWPLNVSL

SEQ ID NO: 841475 - protein, 830 aa, Homo sapiens; identical to SEQ ID NO: 841473

SEQ ID NO: 841476 - protein, 998 aa, Homo sapiens
SGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGASETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPAAPKPAVKSSSSQPVTPVSPVWSPGVAPTQPPAFPTSNPSKGTVVSSIKIAQPSYPPARPASTLNVAGPFKGPQAAVASQNYTPKPTVSTPTVNAVQPGAVGPSNELPGMSGRGAQLFAKRQSRMEKYVVDSDTVQAHAARAQSPTPSLPASWKYSSNVRAPPPVAYNPIHSPSYPLAALKSQPSAAQPSKMGKKKGKKPLNALDVMKHQPYQLNASLFTFQPPDAKDGLPQKSSVKVNSALAMKQALPPRPVNAASPTNVQASSVYSVPAYTSPPSFFAEASSPVSASPVPVGIPTSPKQESASSSYFVAPRPKFSAKKSGVTIQESGRSLSLPGRSVPPPISTSPWVYQPTYSYSSKPTDGLEKANKRPTPWEAAAKSPLGLVDDAFQPRNIQESIVANVVSAARRKVLPGPPEDWNERLSYIPQTQKAYMGSCGRQEYNVTANNNMSTTSQYGSQLPYAYYRQASRNDSAIMSMETRSDYCLPVADYNYNPHPRGWRRQT

SEQ ID NO: 841477 - protein, 538 aa, Homo sapiens
SGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGASETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPAAPKPAVKSSSSQPVTPVSPVWSPGVAPTQPPAFPLFVCISLG

SEQ ID NO: 841478 - protein, 313 aa, Homo sapiens
SGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVKHAHVSPPTYVVVKQCGYR

SEQ ID NO: 841479 - protein, 830 aa, Homo sapiens; identical to SEQ ID NO: 841473

SEQ ID NO: 841480 - protein, 846 aa, Homo sapiens
SGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGASETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPAAPKPAVKSSSSQPVTPVSPVWSPGVAPTQPPAFPTSNPSKGTVVSSIKIAQPSYPPARPASTLNVAGPFKGPQAAVASQNYTPKPTVSTPTVNAVQPGAVGPSNELPGMSGRGAQLFAKRQSRMEKYVVDSDTVQAHAARAQSPTPSLPASWKYSSNVRAPPPVAYNPIHSPSYPLAALKSQPSAAQPSKMGKKKGKKPLNALDVMKHQPYQLNASLFTFQPPDAKDGLPQKSSVKVNSALAMKQALPPRPVNAASPTNVQASSVYSVPAYTSPPSFFAEASSPVSASPVPVGIPTSPKQESASSSYFVAPRPKFSAKKSGVTIQVKCKSGIHSQDIIRTYFPAYLSSST

SEQ ID NO: 841481 - protein, 579 aa, Homo sapiens
SGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGASETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPAAPKPAVKSSSSQPVTPVSPVWSPGVAPTQPPAFPTSNPSKGTVVSSIKIAQPSYPPARPASTLNVAGPFKGPQAAGGGRYELV

SEQ ID NO: 841482 - protein, 253 aa, Homo sapiens
SGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTRRHAKSPPMSHATGPPNVPHKEPVTELI

SEQ ID NO: 841483 - protein, 234 aa, Homo sapiens
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLR

SEQ ID NO: 841484 - protein, 139 aa, Homo sapiens
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQAQGPRGRPRDTAPRVVP

SEQ ID NO: 841485 - protein, 118 aa, Homo sapiens
ALESLVNRAVLLASDAQECTLEEVVERLLSVKGRPRPSPLVKAHKSVQANLDQSQRGSSPQNTTTPKPSVEGQQPAAAAACEPVDHAQSESILKVSQLAPELQLAPELQLAPELAARP

SEQ ID NO: 841486 - protein, 177 aa, Homo sapiens
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAEVRKDGDGVEVTPPPSKGGQSGQFGEGGQP

SEQ ID NO: 841487 - protein, 189 aa, Homo sapiens
MGCAVPVLTWPYCPFHMAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAVAHRPGAFKAELSKLVIVAKASRTEL

SEQ ID NO: 841488 - protein, 173 aa, Homo sapiens
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAVAHRPGAFKAELSKLVIVAKASRTEL

SEQ ID NO: 841489 - protein, 173 aa, Homo sapiens; identical to SEQ ID NO: 841488

SEQ ID NO: 841490 - protein, 173 aa, Homo sapiens; identical to SEQ ID NO: 841488

SEQ ID NO: 841491 - protein, 173 aa, Homo sapiens; identical to SEQ ID NO: 841488

SEQ ID NO: 841492 - protein, 173 aa, Homo sapiens; identical to SEQ ID NO: 841488

SEQ ID NO: 841493 - protein, 173 aa, Homo sapiens; identical to SEQ ID NO: 841488

SEQ ID NO: 841494 - protein, 173 aa, Homo sapiens; identical to SEQ ID NO: 841488

SEQ ID NO: 841495 - protein, 156 aa, Homo sapiens
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAGDCGQGIAH

SEQ ID NO: 841496 - protein, 169 aa, Homo sapiens
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAVISAPQEKGDDQPHWTDGETEA

SEQ ID NO: 841497 - protein, 1982 aa, Homo sapiens
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGVLGMSWNYPIFLVEDSSESDTDSDDYAPPQDGPAAYPIPVQNIKPLLTVSFTSGDISLMNNYDDLSPTVIRSGLKEVVAQWCTQGDLLAVAGMERQTQLGELPNGPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKPDEIYGNSLISTVIDSCNCSDSSDIELSDDWAAKKSPKISRASKSPKLPRISIEARKSPKLPRAAQELSRSPRLPLRKPSVGSPSLTRREFPFEDITQHNYLAQVTSNIWGTKFKIVGLAAFLPTNLGAVIYKTSLLHLQPRQMTIYLPEVRKISMDYINLPVFNPNVFSEDEDDLPGDAVGRIDGSAYILDFQYPFSAVQAFAVALANVTQRLNEETGVGRREMQRAFGRGLRRCQRSPLGVRCLGGPEANSKTGKARQAQERALTCGRHLFGWVLLPFIVCSSFLLSFQWHLEAKSAEAPAVLSGNSLAVVMLYWALQNEDSLPSEPAILLDIGRMHYPVFSSNITTSVKAKSFYKTQPKILKMQVLGEWDGEQHLIYTDYVTPPKGDLINKGHLGRHTVLDQQSRLFTGVFSPGRNAICSLRMLGKGRRVKKKLHRIHRFTSLCRQQCDSACDLEQQYEGYTPLLRMSTLKASTSFIVCQSSVGSVMVIQHDWFWEKVRDKNGKILACGSGSSFPNNVVTVTRSSHAEKQPLLSLPLLLFNLECITVNMIFPMRYHVLCLPILKVWTTLDLKPLFSPLGYIKIQLTTNAFYQIRNVTKKMLSVHQGIKIQREYGQIFDKIFMIFSEQKKLFINCTDCLLRSYNHWRKQLLKLYIPRYLVDQQFVNCIKKNYLEYLFPLPRPRENLWAVFKALMTKPSVFCCCFLLLFFVFVFVFLSLTCDVVEDQAPLLGLLCRSTGTICWRWVPNLHFIWKQTSRRCYRKVFSNLNVFESPVLVKKLEKKPPIFFPDQDDMTSLPILSKPQRNTDEVFCCGKGYFPSNTSFSFIFNVLDLIFLVGAFFQKEFSNVIRINSFDMSLCSLIWCFSAYWLCNNGYSLLDNLNAIPLFCRLGDNYFILLFIVFLGIILLLRFGELYPFYLFRKIVSLLTTYMVTVYFAARNKEDMIEGFFFFFFFFLRRSPTLVAQLECSGTISAPHNLCLQGSGDYFDLSLPSSWDYRHPPTRQANVFVFLIEMGFCHVGQAGLELLTSGDPPASASQSAGITDVSHHSRPIEGFLLDNFNFSNWEKIPINHFKNFFLYFVLLIIYKGDFFFEINTQIVFSSFENFDFYLKITVDLNKKGRPIRMRVAKERVTEVISFTFCVLIVFEYKDPEKAHFRTCLIRANIGEIFEMKATNTCEKKKMDFFSKELTKLLNAYLPPPKALSPDGGTGFCLGCLAHVSLYEFVPELTPAATAHLPSTQGPEEEGLPSCAKADTSCGLCGPSSVTFQLIVVVLFSTMLSFSQSLLTKYDENSYFMQEISKNLMFINSLGISRYLIESPKFKSSPVKGYLYKESMTFGGKCDILTNITNSKFVLALTSSNQRHRFVYNIPIECIILRKIGAKEAGKSQSSNGSINQRISQASVFIHSHCSLVKCLTRTWKNVLCSSCNHSKKSANPRVKPALPQGWMVTLGKSLGLARPPLVHLCNERISLDSPLNSLTALSLRAQH

SEQ ID NO: 841498 - protein, 209 aa, Homo sapiens
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMVLLSKQDLLRLPNAF

SEQ ID NO: 841499 - protein, 60 aa, Homo sapiens
PVENTEIDCDSSFFFSSYRSTTILLRSRLISGEPNLRLWAWLLSCQPTSVQVKIMSSSLI

SEQ ID NO: 841500 - protein, 1543 aa, Homo sapiens
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGVLGMSWNYPIFLVEDSSESDTDSDDYAPPQDGPAAYPIPVQNIKPLLTVSFTSGDISLMNNYDDLSPTVIRSGLKEVVAQWCTQGDLLAVAGMERQTQLGELPNGPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKPDEIYGNSLISTVIDSCNCSDSSDIELSDDWAAKKSPKISRASKSPKLPRISIEARKSPKLPRAAQELSRSPRLPLRKPSVGSPSLTRREFPFEDITQHNYLAQVTSNIWGTKFKIVGLAAFLPTNLGAVIYKTSLLHLQPRQMTIYLPEVRKISMDYINLPVFNPNVFSEDEDDLPVTGASGVPENSPPCTVNIPIAPIHSSAQAMSPTQSIGLVQSLLANQNVQLDVLTNQTTAVGTAEHAGDSATQYPVSNRYSNPGQVIFGSVEMGRIIQNPPPLSLPPPPQGPMQLSTVGHGDRDHEHLQKSAKALRPTPQLAAEGDAVVFSAPQEVQVTKINPPPPYPGTIPAAPTTAAPPPPLPPPQPPVDVCLKKGDFSLYPTSVHYQTPLGYERITTFDSSGNVEEVCRPRTRMLCSQNTYTLPGPGSSATLRLTATEKKVPQPCSSATLNRLTVPRYSIPTGDPPPYPEIASQLAQGRGAAQRSDNSLIHATLRRNNREATLKMAQLADSPRAPLQPLAKSKGGPGGVVTQLPARPPPALYTCSQCSGTGPSSQPGASLAHTASASPLASQSSYSLLSPPDSARDRTDYVNSAFTEDEALSQHCQLEKPLRHPPLPEAAVTLKRPPPYQWDPMLGEDVWVPQERTAQTSGPNPLKLSSLMLSQGQHLDVSRLPFISPKSPASPTATFQTGYGMGVPYPGSYNNPPLPGVQAPCSPKDALSPTQFAQQEPAVVLQPLYPPSLSYCTLPPMYPGSSTCSSLQLPPVALHPWSSYSACPPMQNPQGTLPPKPHLVVEKPLVSPPPADLQSHLGTEVMVETADNFQEVLSLTESPVPQRTEKFGKKNRKRLDSRAEEGSVQAITEGKVKKEARTLSDFNSLISSPHLGREKKKVKSQKDQLKSKKLNKTNEFQDSSESEPELFISGDELMNQSQGSRKGWKSKRSPRAAGELEEAKCRRASEKEDGRLGSQGFVYVMANKQPLWNEATQVYQLDFGGRVTQESAKNFQIELEGRQVMQFGRIDGSAYILDFQYPFSAVQAFAVALANVTQRLK

SEQ ID NO: 841501 - protein, 423 aa, Homo sapiens
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGVLGMSWNYPIFLVEDSSESDTDSDDYAPPQDGPAAYPIPVQNIKPLLTVSFTSGDISLMNNYDDLSPTVIRSGLKEVVAQWCTQGDLLAVAGMERQTQLGELPNGPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPHNCLS

SEQ ID NO: 841502 - protein, 35 aa, Homo sapiens
LAGHTKGSRISSKSNNMSLKYWGYMSMTLLELHFQ

SEQ ID NO: 841503 - protein, 36 aa, Homo sapiens
LCGGEELGAFHGVNPCLPGIPHSTEEEKLGAQPLTH

SEQ ID NO: 841504 - protein, 303 aa, Homo sapiens
SQTSGRGGEGLPVGVAGWWICRSRFPVARGGHCWLLNGLQGGYPRQGLWIGRGYIRLSRSFPSQSGGLRRRSPVMDYRRLLMSRVVPGQFDDADSSDSENRDLKTVKEKDDILFEDLQDNVNENGEGEIEDEEEEGYDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVYHASTANGESRAIKIYKTSILVFKDRDKYVSGEFR

SEQ ID NO: 841505 - protein, 327 aa, Homo sapiens
MVKTWAEKEMRNLIRLNTAEIPCPEPIMLRSHVLVMSFIGKDDMPAPLLKNVQLSESKARELYLQVIQYMRRMYQDARLVHADLSEFNMLYHGGGVYIIDVSQSVEHDHPHALEFLRKDCANVNDFFMRHSVAVMTVRELFEFVTDPSITHENMDAYLSKAMEIASQRTKEERSSQDHVDEEVFKRAYIPRTLNEVKNYERDMDIIMKLKEEDMAMNAQQDNILYQTVTGLKKDLSGVQKVPALLENQVEERTCSDSEDIGSSECSDTDSEEQGDHARPKKHTTDPDIDKKERKKMVKEAQREKRKNKIPKHVKKRKEKTAKTKKGK

SEQ ID NO: 841506 - protein, 544 aa, Homo sapiens
SQTSGRGGEGLPVGVAGWWICRSRFPVARGGHCWLLNGLQGGYPRQGLWIGRGYIRLSRSFPSQSGGLRRRSPVMDYRRLLMSRVVPGQFDDADSSDSENRDLKTVKEKDDILFEDLQDNVNENGEGEIEDEEEEGYDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVYHASTANGESRAIKIYKTSILVFKDRDKYVSGEFRFRHGYCKGNPRKMVKTWAEKEMRNLIRLNTAEIPCPEPIMLRSHVLVMSFIGKDDMPAPLLKNVQLSESKARELYLQVIQYMRRMYQDARLVHADLSEFNMLYHGGGVYIIDVSQSVEHDHPHALEFLRKDCANVNDFFMRHSVAVMTVRELFEFVTDPSITHENMDAYLSKAMEIASQRTKEERSSQDHVDEEVFKRAYIPRTLNEVKNYERDMDIIMKLKEEDMAMNAQQDNVSSLVCI

SEQ ID NO: 841507 - protein, 441 aa, Homo sapiens
SQTSGRGGEGLPVGVAGWWICRSRFPVARGGHCWLLNGLQGGYPRQGLWIGRGYIRLSRSFPSQSGGLRRRSPVMDYRRLLMSRVVPGQFDDADSSDSENRDLKTVKEKDDILFEDLQDNVNENGEGEIEDEEEEGYDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVYHASTANGESRAIKIYKTSILVFKDRDKYVSGEFRFRHGYCKGNPRKMVKTWAEKEMRNLIRLNTAEIPCPEPIMLRSHVLVMSFIGKDDMPAPLLKNVQLSESKARELYLQVIQYMRRMYQDARLVHADLSEFNMLYHGGGVYIIDVSQSVEHDHPHALEFLRKDCANVNGE

SEQ ID NO: 841508 - protein, 347 aa, Homo sapiens
SQTSGRGGEGLPVGVAGWWICRSRFPVARGGHCWLLNGLQGGYPRQGLWIGRGYIRLSRSFPSQSGGLRRRSPVMDYRRLLMSRVVPGQFDDADSSDSENRDLKTVKEKDDILFEDLQDNVNENGEGEIEDEEEEGYDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVYHASTANGESRAIKIYKTSILVFKDRDKYVSGEFRFRHGYCKGNPRKMVKTWAEKEMRNLIRLNTAEIPCPAWATKLES

SEQ ID NO: 841509 - protein, 151 aa, Homo sapiens
SQTSGRGGEGLPVGVAGWWICRSRFPVARGGHCWLLNGLQGGYPRQGLWIGRGYIRLSRSFPSQSGGLRRRSPVMDYRRLLMSRVVPGQFDDADSSDSENRDLKTVKEKDDILFEDLQDNVNENGEGEIEDEEEEGYDDDDDDWDWHQRLG

SEQ ID NO: 841510 - protein, 642 aa, Homo sapiens
SQTSGRGGEGLPVGVAGWWICRSRFPVARGGHCWLLNGLQGGYPRQGLWIGRGYIRLSRSFPSQSGGLRRRSPVMDYRRLLMSRVVPGQFDDADSSDSENRDLKTVKEKDDILFEDLQDNVNENGEGEIEDEEEEGYDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVYHASTANGESRAIKIYKTSILVFKDRDKYVSGEFRFRHGYCKGNPRKMVKTWAEKEMRNLIRLNTAEIPCPEPIMLRSHVLVMSFIGKDDMPAPLLKNVQLSESKARELYLQVIQYMRRMYQDARLVHADLSEFNMLYHGGGVYIIDVSQSVEHDHPHALEFLRKDCANVNDFFMRHSVAVMTVRELFEFVTDPSITHENMDAYLSKAMEIASQRTKEERSSQDHVDEEVFKRAYIPRTLNEVKNYERDMDIIMKLKEEDMAMNAQQDNILYQTVTGLKKDLSGVQKVPALLENQVEERTCSDSEDIGSSECSDTDSEEQGDHARPKKHTTDPDIDKKERKKMVKEAQREKRKNKIPKHVKKRKEKTAKTKKGK

SEQ ID NO: 841511 - protein, 642 aa, Homo sapiens; identical to SEQ ID NO: 841510

SEQ ID NO: 841512 - protein, 642 aa, Homo sapiens; identical to SEQ ID NO: 841510

SEQ ID NO: 841513 - protein, 125 aa, Homo sapiens
MDIIMKLKEEDMAMNAQQDNILYQTVTGLKKDLSGVQKVPALLENQVEERTCSDSEDIGSSECSDTDSEEQGDHARPKKHTTDPDIDKKERKKMVKEAQREKRKNKIPKHVKKRKEKTAKTKKGK

SEQ ID NO: 841514 - protein, 169 aa, Homo sapiens
SQTSGRGGEGLPVGVAGWWICRSRFPVARGGHCWLLNGLQGGYPRQGLWIGRGYIRLSRSFPSQSGGLRRRSPVMDYRRLLMSRVVPGQFDDADSSDSENRDLKTVKEKDDILFEDLQDNVNENGEGEIEDEEEEGYDDDDDDWDWDEGVGKLAKGYVWNGGSNPQLVP

SEQ ID NO: 841515 - protein, 496 aa, Homo sapiens
GGQPEGGLPVSPEPSLLTPTEEAHPASSLASFPAAQIPIAVEEPGSSSRESVSKAGMPVSADAAKEVVDAGLVGLERQVSDLGSKGEHPEGDPGEVPAPSPQERGEHLNTEQSHEVQPGVPPPPLPKEQSHEVQPGAPPPPLPKAPSESARGPPGPTDGAKVHEDSTSPAVAKEGSRSPGDSPGGKEEAPEPPDGGDPGNLQGEDSQAFSSKRDPEVGKDELSKPSSDAESRDHPSSHSAQPPRKGGAGHTDGPHSQTAEADASGLPHKLGEEDPVLPPVPDGAGEPTVPEGAIWEGSGLQPKCPDTLQSREGLGRMESFLTLESEKSDFPPTPVAEVAPKAQEGESTLEIRKMGSCDGEGLLTSPDQPRGPACDASRQEFHAGVPHPPQGENLAADLGLTALILDQDQQGIPSCPGEGWIRGAASEWPLLSSEKHFQPSQAQPETSIFDVLKEQAQPPENGKETSPSHPGFKDQGADSSQIHVPVEPQEDNNHTW

SEQ ID NO: 841516 - protein, 131 aa, Homo sapiens
MAVVLRVSVDWDKQHVRAGVPHPPQGENLAADLGLTALILDQDQQGIPSCPGEGWIRGAASEWPLLSSEKHFQPSQAQPETSIFDVLKEQAQPPENGKETSPSHPGFKDQGADSSQIHVPVEPQEDNNHTW

SEQ ID NO: 841517 - protein, 644 aa, Homo sapiens
GGQPEGGLPVSPEPSLLTPTEEAHPASSLASFPAAQIPIAVEEPGSSSRESVSKAGMPVSADAAKEVVDAGLVGLERQVSDLGSKGEHPEGDPGEVPAPSPQERGEHLNTEQSHEVQPGVPPPPLPKEQSHEVQPGAPPPPLPKAPSESARGPPGPTDGAKVHEDSTSPAVAKEGSRSPGDSPGGKEEAPEPPDGGDPGNLQGEDSQAFSSKRDPEVGKDELSKPSSDAESRDHPSSHSAQPPRKGGAGHTDGPHSQTAEADASGLPHKLGEEDPVLPPVPDGAGEPTVPEGAIWEGSGLQPKCPDTLQSREGLGRMESFLTLESEKSDFPPTPVAEVAPKAQEGESTLEIRKMGSCDGEGLLTSPDQPRGPACDASRQEFHAGVPHPPQGENLAADLGLTALILDQDQQGIPSCPGEGWIRGAASEWPLLSSEKHFQPSQAQPETSIFDVLKEQAQPPENGKETSPSHPGFKDQGADSSQIHVPVEPQEDNNLPTHGGQEQALGSELQSQLPKGTLSDTPTSSPTDMVWESSLTEESELSAPTRQKLPALGEKRPEGACGDGQSSRVSPPAADVLKDFSLAGNFSRKETCCTGQGPNKSQQALADALEEGSQHEEACQRHPGASEAADGCSPLWGLSKREMAS

SEQ ID NO: 841518 - protein, 1593 aa, Homo sapiens
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKDSVNISQKQELWREKWERHNLPSRSLSRRSISKERWVETLVVADTKMIEYHGSENVESYILTIMNMVTGLFHNPSIGNAIHIVVVRLILLEEEEQGLKIVHHAEKTLSSFCKWQKSINPKSDLNPVHHDVAVLLTRKDICAGFNRPCETLGLSHLSGMCQPHRSCNINEDSGLPLAFTIAHELGHSFGIQHDGKENDCEPVGRHPYIMSRQLQYDPTPLTWSKCSEEYITRFLDRGWGFCLDDIPKKKGLKSKVIAPGVIYDVHHQCQLQYGPNATFCQEVENVCQTLWCSVKGFCRSKLDAAADGTQCGEKKWCMAGKCITVGKKPESIPGGWGRWSPWSHCSRTCGAGVQSAERLCNNPEPKFGGKYCTGERKRYRLCNVHPCRSEAPTFRQMQCSEFDTVPYKNELYHWFPIFNPAHPCELYCRPIDGQFSEKMLDAVIDGTPCFEGGNSRNVCINGICKMVGCDYEIDSNATEDRCGVCLGDGSSCQTVRKMFKQKEGSGYVDIGLIPKGARDIRVMEIEGAGNFLAIRSEDPEKYYLNGGFIIQWNGNYKLAGTVFQYDRKGDLEKLMATGPTNESVWIQLLFQVTNPGIKYEYTIQKDGLDNDVEQMYFWQYGHWTECSVTCGTGIRRQTAHCIKKGRGMVKATFCDPETQPNGRQKKCHEKACPPRWWAGEWEACSATCGPHGEKKRTVLCIQTMVSDEQALPPTDCQHLLKPKTLLSCNRDILCPSDWTVGNWSECSVSCGGGVRIRSVTCAKNHDEPCDVTRKPNSRALCGLQQCPSSRRVLKPNKGTISNGKNPPTLKPVPPPTSRPRMLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWKRVECTTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRIVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 841519 - protein, 564 aa, Homo sapiens
MLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWKRVECTTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRIVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 841520 - protein, 730 aa, Homo sapiens
MRLEEWDIMRIWRQWVHRARRWWAGEWEACSATCGPHGEKKRTVLCIQTMVSDEQALPPTDCQHLLKPKTLLSCNRDILCPSDWTVGNWSECSVSCGGGVRIRSVTCAKNHDEPCDVTRKPNSRALCGLQQCPSSRRVLKPNKGTISNGKNPPTLKPVPPPTSRPRMLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWKRVECTTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRIVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 841521 - protein, 110 aa, Homo sapiens
TQAGLKLLGSSNLSTLASESAGTAGMSHHAQPETCCSVWIVDSVFLFRLILFHPLNFLFHSSPCNRLRPSSSMVTGRNCSPIANAVTIRNLLLSNYLQINAQMICCEVSR

SEQ ID NO: 841522 - protein, 139 aa, Homo sapiens
MPPKQELGSGVGELAKNSKRQHWNHRWNKIFKIDQMGRWFVAGGAAVGLGALCYYGLGLSNEIGAIEKAVIWPQYVKDRIHSTYMYLAGSIGLTACVCHSNQQNACSHELHDERLLGDNWCDLLQPWVGAGNAGTINTI

SEQ ID NO: 841523 - protein, 139 aa, Homo sapiens; identical to SEQ ID NO: 841522

SEQ ID NO: 841524 - protein, 139 aa, Homo sapiens; identical to SEQ ID NO: 841522

SEQ ID NO: 841525 - protein, 139 aa, Homo sapiens; identical to SEQ ID NO: 841522

SEQ ID NO: 841526 - protein, 139 aa, Homo sapiens; identical to SEQ ID NO: 841522

SEQ ID NO: 841527 - protein, 139 aa, Homo sapiens; identical to SEQ ID NO: 841522

SEQ ID NO: 841528 - protein, 144 aa, Homo sapiens
METMRRRKAKELGSGVGELAKNSKRQHWNHRWNKIFKIDQMGRWFVAGGAAVGLGALCYYGLGLSNEIGAIEKAVIWPQYVKDRIHSTYMYLAGSIGLTACVCHSNQQNACSHELHDERLLGDNWCDLLQPWVGAGNAGTINTI

SEQ ID NO: 841529 - protein, 77 aa, Homo sapiens
CGRFSDRGLPVIGCSYYLRPFDVATCSAPEELCSLRPTLGARKGNCEAKVTGDRAFQICSVDLVHHHHVGCKAGVSP

SEQ ID NO: 841530 - protein, 148 aa, Homo sapiens
MGAQWWLPLTILGGSSSHQSCMVHQLALWGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 841531 - protein, 171 aa, Homo sapiens
LASHLVAWPPTWLRPPTWLQEGVMGAQWWLPLTILGGSSSHQSCMVHQLALWGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 841532 - protein, 174 aa, Homo sapiens
SHLIRDTTLEIPAAEVYQYGDQGQGVMGAQWWLPLTILGGSSSHQSCMVHQLALWGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 841533 - protein, 139 aa, Homo sapiens; identical to SEQ ID NO: 841522

SEQ ID NO: 841534 - protein, 139 aa, Homo sapiens; identical to SEQ ID NO: 841522

SEQ ID NO: 841535 - protein, 77 aa, Homo sapiens; identical to SEQ ID NO: 841529

SEQ ID NO: 841536 - protein, 139 aa, Homo sapiens; identical to SEQ ID NO: 841522

SEQ ID NO: 841537 - protein, 139 aa, Homo sapiens; identical to SEQ ID NO: 841522

SEQ ID NO: 841538 - protein, 139 aa, Homo sapiens; identical to SEQ ID NO: 841522

SEQ ID NO: 841539 - protein, 139 aa, Homo sapiens; identical to SEQ ID NO: 841522

SEQ ID NO: 841540 - protein, 139 aa, Homo sapiens; identical to SEQ ID NO: 841522

SEQ ID NO: 841541 - protein, 139 aa, Homo sapiens; identical to SEQ ID NO: 841522

SEQ ID NO: 841542 - protein, 139 aa, Homo sapiens; identical to SEQ ID NO: 841522

SEQ ID NO: 841543 - protein, 139 aa, Homo sapiens; identical to SEQ ID NO: 841522

SEQ ID NO: 841544 - protein, 176 aa, Homo sapiens
MPPKQELGSGVGELAKNSKRQHWNHRWNKIFKIDQMGRWFVAGGAAVGLGALCYYGLGLSNEIGAIEKAVIWPQYVKDRIHSTYMYLAGSIGLTACVCHSNQQNACSHELHDERLLGDNWCDLLQPWVGAGNAGCDGCPVVAPSDNIRGVLFSSELHGTPAGIVGRPLHCGHVCAQ

SEQ ID NO: 841545 - protein, 76 aa, Homo sapiens
AARTLRGRQKGKLRGEGDRGPSISDLLGRPGAPPPCWLQGWCVSVTLPSRVFHPAFTNGLPCCEEFHHEESMAVNT

SEQ ID NO: 841546 - protein, 148 aa, Homo sapiens; identical to SEQ ID NO: 841530

SEQ ID NO: 841547 - protein, 144 aa, Homo sapiens
HASVDPRVRTLGARKGNCEAKVTGDRGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 841548 - protein, 96 aa, Homo sapiens
LTKGPDIGVSVGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 841549 - protein, 77 aa, Homo sapiens; identical to SEQ ID NO: 841529

SEQ ID NO: 841550 - protein, 128 aa, Homo sapiens
MVLNFFENFFRTLEPRCQGGVFVLPLSSWLSFSKLLNFWAHFIEMGTEISATMIVDGRRSPICISRACLVNVGGINTTLLGASAFQPLDAGAICKIFSVVAISEAATGGTEETIIVLSPTILTDSCPG

SEQ ID NO: 841551 - protein, 129 aa, Homo sapiens [sequence omitted]

SEQ ID NO: 841552 - protein, 137 aa, Homo sapiens
NTISWRILKHIMTQLKWDRGTDFVRSSPGNSSVQPGWELLTVQNAKEVGGRRATGNKDTWERCIKEEENTNGQPQRCTHLLTEKGNLERHQLCRERNRSIFNVSVLVTAGTVVAAKRLSDQRPYRHSCRNTRQRGIG

SEQ ID NO: 841553 - protein, 471 aa, Homo sapiens
MTSFYSTSSCPLGCTMAPGARNVFVSPIDVGCQPVAEANAASMCLLANVAHANRVRVGSTPLGRPSLCLPPTSHTACPLPGTCHIPGNIGICGAYGKNTLNGHEKETMKFLNDRLANYLEKVRQLEQENAELETTLLERSKCHESTVCPDYQSYFRTIEELQQKILCSKAENARLIVQIDNAKLAADDFRIKLESERSLHQLVEADKCGTQKLLDDATLAKADLEAQQESLKEEQLSLKSNHEQEVKILRSQLGEKFRIELDIEPTIDLNRVLGEMRAQYEAMVETNHQDVEQWFQAQSEGISLQAMSCSEELQCCQSEILELRCTVNALEVERQAQHTLKDCLQNSLCEAEDRYGTELAQMQSLISNLEEQLSEIRADLERQNQEYQVLLDVKARLENEIATYRNLTPLQSLFHACLLYFLSKLWPCHRWVSLWPWSQHGEMILKARVRRLRLVALGSGVPSPCPVFLQD

SEQ ID NO: 841554 - protein, 442 aa, Homo sapiens
MTSFYSTSSCPLGCTMAPGARNVFVSPIDVGCQPVAEANAASMCLLANVAHANRVRVGSTPLGRPSLCLPPTSHTACPLPGTCHIPGNIGICGAYGKNTLNGHEKETMKFLNDRLANYLEKVRQLEQENAELETTLLERSKCHESTVCPDYQSYFRTIEELQQKILCSKAENARLIVQIDNAKLAADDFRIKLESERSLHQLVEADKCGTQKLLDDATLAKADLEAQQESLKEEQLSLKSNHEQEVKILRSQLGEKFRIELDIEPTIDLNRVLGEMRAQYEAMVETNHQDVEQWFQAQVSGGYRAREYLASSEQGGDCVFSVLQSEGISLQAMSCSEELQCCQSEILELRCTVNALEVERQAQHTLKDCLQNSLCEAEDRYGTELAQMQSLISNLEEQLSEIRADLERQNQEYQVLLDVKARLENEIATYRNLLESEDCKYV

SEQ ID NO: 841555 - protein, 61 aa, Homo sapiens
MSCSEELQCCQSEILELRCTVNALEVERQAQHTLVRVLHPHCTANAPCHVLVVASLKVSQI

SEQ ID NO: 841556 - protein, 497 aa, Homo sapiens
MTSFYSTSSCPLGCTMAPGARNVFVSPIDVGCQPVAEANAASMCLLANVAHANRVRVGSTPLGRPSLCLPPTSHTACPLPGTCHIPGNIGICGAYGKNTLNGHEKETMKFLNDRLANYLEKVRQLEQENAELETTLLERSKCHESTVCPDYQSYFRTIEELQQKILCSKAENARLIVQIDNAKLAADDFRIKLESERSLHQLVEADKCGTQKLLDDATLAKADLEAQQESLKEEQLSLKSNHEQEVKILRSQLGEKFRIELDIEPTIDLNRVLGEMRAQYEAMVETNHQDVEQWFQAQVSGGYRAREYLASSEQGGDCVFSVLQSEGISLQAMSCSEELQCCQSEILELRCTVNALEVERQAQHTLKDCLQNSLCEAEDRYGTELAQMQSLISNLEEQLSEIRADLERQNQEYQVLLDVKARLENEIATYRNLTPLQSLFHACLLYFLSKLWPCHRWVSLWPWSQHGEMILKARVRRLRLVALGSGVPSPCPVFLQD

SEQ ID NO: 841557 - protein, 88 aa, Homo sapiens
SSKESTSTKAKTTEQGCSAESKEKVLEGSKLPDQEKAVSEHIPYLSPYHSSSYRYANIPAHARHYQSYMQLIQQKSAVEYAQSQLSLV

SEQ ID NO: 841558 - protein, 117 aa, Homo sapiens
TSPSSSPSTPPLTGNTAATWVVGNQQPPHLSHLKAFGLAVSSAWISLPPISALLACLLPQVSTEMPPPLRSLPCSSRPITSILIPCFFLGIYHRLICDTQRFICLFACRMSVSTTRM

SEQ ID NO: 841559 - protein, 271 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGRGMAIMDLVMMEVVEATMILSITTISLHILDP

SEQ ID NO: 841560 - protein, 116 aa, Homo sapiens
TLPGSYLLGGPEKQSSSMCKYTALWLLPLVSKLPCPEGPLTMVHFKEEKRHPGCQLGSRRHSHLSHELQSEPDIGQVEATPQTSNSSCKTKANIGKSCKRHCFQKSSDHPQRSWLT

SEQ ID NO: 841561 - protein, 131 aa, Homo sapiens
MNSGQRQAVADLENDYTIDGSTPLPTIRSPAWVCKSELLVRRWQLMSNQSKLNGKLMSSLSEQTSFLHKQGQSIYNPVYFIKAKTHLHLHNFTMELMIYLHKAYAKSHLYTVFNKDPCHSDVIINKVTLDK

SEQ ID NO: 841562 - protein, 109 aa, Homo sapiens
QSFLPGRLGTVPTPEANLVLNLLFLALGSFGGGLAKAQNRKALGCAGSKEKGCSGTGPPPRTKKLGRVRDYFSLSRTLKRQEPSSLILPPHPPPPPLKNSQSRSFSETC

SEQ ID NO: 841563 - protein, 67 aa, Homo sapiens
TGFHYVGQAGLQLLTSSDLPASASQSSGITGVSHCSGPISGTFYLPTEMRHPFISGPFLLCCPAGGQ

SEQ ID NO: 841564 - protein, 76 aa, Homo sapiens
NSDRGPLGFGGFLTRGFPKAAAPVRHSGDHGKRLFVIRPSRFYDRRFLKLLRFYIALTGIPVAIFITLVNVFMWSS

SEQ ID NO: 841565 - protein, 189 aa, Homo sapiens
MAAMSLLRRVSVTAVAALSGRPLGTRLGFGGFLTRGFPKAAAPVRHSGDHGKRLFVIRPSRFYDRRFLKLLRFYIALTGIPVAIFITLVNVFIGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 841566 - protein, 115 aa, Homo sapiens
SSGINAECPLRPGVVPVVAMAAMSLLRRVSVTAVAALSGRPLGTRLGFGGFLTRGFPKAAAPVRHSGDHGKRLFVIRPSRFYDRRFLKLLRFYIALTGIPVAIFITLVNVFMWSS

SEQ ID NO: 841567 - protein, 189 aa, Homo sapiens; identical to SEQ ID NO: 841565

SEQ ID NO: 841568 - protein, 90 aa, Homo sapiens
SSGINAECPLRPGVVPVVAMAAMSLLRRVSVTAVAALSGRPLGTRLGFGGFLTRGFPKAAGQAELAEIPEGYVPEHWEYYKHPISRWMCP

SEQ ID NO: 841569 - protein, 84 aa, Homo sapiens
SSGINAECPLRPGVVPVVAMAAMSLLRRVSVTAVAALSGRPLGTRLGFGGFLTRGFPKAAAPGNHHSAVFMILTTLFLIDSTLH

SEQ ID NO: 841570 - protein, 116 aa, Homo sapiens
MAAMSLLRRVSVTAVAALSGRPLGTRLGFGGFLTRGFPKAAAPVRHSGDHGKRLFVIRPSRFYDRRFLKLLALYEQSRGLENGRLSGPSATRFYIALTGIPVAIFITLVNVFMWSS

SEQ ID NO: 841571 - protein, 89 aa, Homo sapiens
ILAIAFMSLSRAGMVIVHVGIVCLVRSILDIDYVIWSGSPTYTDRAFPERASVALCDRQYVNDRFVEESTYLVSPSTLRSTTYELGCSN

SEQ ID NO: 841572 - protein, 115 aa, Homo sapiens; identical to SEQ ID NO: 841566

SEQ ID NO: 841573 - protein, 115 aa, Homo sapiens; identical to SEQ ID NO: 841566

SEQ ID NO: 841574 - protein, 134 aa, Homo sapiens
SSGINAECPLRPGVVPVVAMAAMSLLRRVSVTAVAALSGRPLGTRLGFGGFLTRGFPKAAAPVRHSGDHGKRLFVIRPSRFYDRRFLKLLRFYIALTGIPVAIFITLVNVFMWVKELEVRKLMHVRGDGPWVLL

SEQ ID NO: 841575 - protein, 170 aa, Homo sapiens
SSGINAECPLRPGVVPVVAMAAMSLLRRVSVTAVAALSGRPLGTRLGFGGFLTRGFPKAAAPVRHSGDHGKRLFVIRPSRFYDRRFLKLLRFYIALTGIPVAIFITLVNVFMCIPYQDGCARNFYDSPEKIYERTMAVLQIEAEKAELRVKELEVRKLMHVRGDGPWVLL

SEQ ID NO: 841576 - protein, 115 aa, Homo sapiens; identical to SEQ ID NO: 841566

SEQ ID NO: 841577 - protein, 93 aa, Homo sapiens
KQWYQRRVPITAGGSARSSHGGHEFVAAGFGYCGGSSVWPAPWHSPRIWGLPHSWLSEGCWVIQYSQLLFDTVETMGKDYLSSDLLDSMTGVF

SEQ ID NO: 841578 - protein, 87 aa, Homo sapiens
SSGINAECPLRPGVVPVVAMAAMSLLRRVSVTAVAALSGRPLGTRLGFGGFLTRGFPKAAEILHCIDWDSSSNFHNSGECIHVVKLN

SEQ ID NO: 841579 - protein, 81 aa, Homo sapiens
SSGINAECPLRPGVVPVVAMAAMSLLRRVSVTAVAALSGRPLGTRLGFGGFLTRGFPKAAAPGNHHSAVFMILTTLFLMSS

SEQ ID NO: 841580 - protein, 93 aa, Homo sapiens; identical to SEQ ID NO: 841577

SEQ ID NO: 841581 - protein, 90 aa, Homo sapiens; identical to SEQ ID NO: 841568

SEQ ID NO: 841582 - protein, 189 aa, Homo sapiens; identical to SEQ ID NO: 841565

SEQ ID NO: 841583 - protein, 189 aa, Homo sapiens; identical to SEQ ID NO: 841565

SEQ ID NO: 841584 - protein, 77 aa, Homo sapiens
QLPWQRHSSPQRGPTQSSTIYNRGPKLGRVVAVLGLAVGPATLTVHTEPEPGLTSVSLKTPSAYMGPNPWLLHTSNE

SEQ ID NO: 841585 - protein, 66 aa, Homo sapiens
CSRSELLPACLSGSRHQAHLARNTSRGGTGPEDWTPRVLWNVYGNKGGPNGQQRNTMPSSGLVGGP

SEQ ID NO: 841586 - protein, 407 aa, Homo sapiens
PVPAVLSWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 841587 - protein, 339 aa, Homo sapiens
MFYFLPQPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 841588 - protein, 407 aa, Homo sapiens; identical to SEQ ID NO: 841586

SEQ ID NO: 841589 - protein, 433 aa, Homo sapiens
RGTLAVRAGGSAECLPSASVWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFFLETRPRKGDRGWGNPLPFPKGNISSTWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 841590 - protein, 211 aa, Homo sapiens
MLQLLIPYVPTREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 841591 - protein, 407 aa, Homo sapiens; identical to SEQ ID NO: 841586

SEQ ID NO: 841592 - protein, 407 aa, Homo sapiens; identical to SEQ ID NO: 841586

SEQ ID NO: 841593 - protein, 300 aa, Homo sapiens
MCRVLPFGIGDEWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 841594 - protein, 215 aa, Homo sapiens
MYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 841595 - protein, 302 aa, Homo sapiens
PVPAVLSWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLDLFF

SEQ ID NO: 841596 - protein, 75 aa, Homo sapiens
MDSRRVQLGLECPDAFNKNNPHCSLTLQVGMETRRVQQQLRPPGLLMLRWSMELRRNTTPVYQGSRYGRSCCRSG

SEQ ID NO: 841597 - protein, 138 aa, Homo sapiens
MDEVCATTSSMVIAQYGHSACAARTSSTRTCNNFVQHDFSASGDSACACTRRGTIHTHTHHDLVIKKLFLSFISWLIKINQFFPRKSLVILHIAKIHHSKILDGEKLMVQSTATLIVQPIFNTFYNNHTKWSLVNINP

SEQ ID NO: 841598 - protein, 69 aa, Homo sapiens
HLISYPSPKTNSKPPYVLTLFSDDPLTFRLGLKLVSRTRALPCESCTTWTGSELGVCPPHCHFLPLPPP

SEQ ID NO: 841599 - protein, 82 aa, Homo sapiens
SSRGYCIRGGARNFTLVTQAECNGSIDILITCDTSGALMFVSRFIPYPCCRMGGNCGQMEAETQGGRRASLRSHLAAPGLLP

SEQ ID NO: 841600 - protein, 112 aa, Homo sapiens
FVLLLWLAIGTHHVRPEVRGGIHRRGPGWLPCVLREQSRALSGVARGPGRSSRGLGPADVASLKMRSQGEAPPPTSGRFSCVALSFQAHLAVPFSACLSPPSCPLLLWTAFG

SEQ ID NO: 841601 - protein, 62 aa, Homo sapiens
NTSFAPNACAVHVGCGASPQHAPQDTEVTLWGSAQPCPLKATCTQVHSTGIWRKEVYVVAVS

SEQ ID NO: 841602 - protein, 136 aa, Homo sapiens
GRKALFESTHRDRQLRKERHGSHRWDDSAEAGMHPAGRPPALPAVSTQRHRCLLGRSGAGPVCLNVPVEAAWALQDGACSVSAPAGLSVLAELSTYCVCAGHSAESVQTAGWGLPGGGDCFVLRDRQISFKMRARD

SEQ ID NO: 841603 - protein, 887 aa, Homo sapiens
MDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 841604 - protein, 164 aa, Homo sapiens [sequence omitted]

SEQ ID NO: 841605 - protein, 887 aa, Homo sapiens; identical to SEQ ID NO: 841603

SEQ ID NO: 841606 - protein, 916 aa, Homo sapiens
MRNTSMDLCPRPKISCAVPGSYNFSLPCAMDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 841607 - protein, 925 aa, Homo sapiens
MIDLSPNPLFGSLLPRESLEKPQRELPPLLPGAGLPCAMDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 841608 - protein, 545 aa, Homo sapiens
MIRPSRCQHSSHSSNPIQPYRRYRFHPRLSMIYPTLQLMRPTTNSPSKPNPSLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 841609 - protein, 211 aa, Homo sapiens
MPEVRQSSFALLGDLTKACFIHVKPCIAEFMPILGTNLNPEFISVCNNATWAIGEICMQMGAEMQPYVQMVLNNLVEIINRPNTPKTLLENTAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 841610 - protein, 328 aa, Homo sapiens
MYTQHPEQYEAPDKDFMIVALDLLSGLAEGLGGHVEQLVARSNIMTLLFQCMQDSMPEVRQSSFALLGDLTKACFIHVKPCIGTTLALSLTHDPSPGLKGWRAIPGDDCDHIGMYSYCLMGPAGQVLQLTLAGPPSQHPCFSPPAEFMPILGTNLNPEFISVCNNATWAIGEICMQMGAEMQPYVQMVLNNLVEIINRPNTPKTLLENTAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 841611 - protein, 925 aa, Homo sapiens; identical to SEQ ID NO: 841607

SEQ ID NO: 841612 - protein, 925 aa, Homo sapiens; identical to SEQ ID NO: 841607

SEQ ID NO: 841613 - protein, 925 aa, Homo sapiens; identical to SEQ ID NO: 841607

SEQ ID NO: 841614 - protein, 925 aa, Homo sapiens; identical to SEQ ID NO: 841607

SEQ ID NO: 841615 - protein, 935 aa, Homo sapiens
MIDLSPNPLFGSLLPRESLEKPQRELPPLLPGAGLPCAMDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTGRLTSPSAIPAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 841616 - protein, 758 aa, Homo sapiens
MIDLSPNPLFGSLLPRESLEKPQRELPPLLPGAGLPCAMDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIGTTLALSLTHDPSPGLK

SEQ ID NO: 841617 - protein, 432 aa, Homo sapiens
MIDLSPNPLFGSLLPRESLEKPQRELPPLLPGAGLPCAMDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLSVCPCLGVVVGWQALDSLLGGD

SEQ ID NO: 841618 - protein, 925 aa, Homo sapiens; identical to SEQ ID NO: 841607

SEQ ID NO: 841619 - protein, 935 aa, Homo sapiens; identical to SEQ ID NO: 841615

SEQ ID NO: 841620 - protein, 925 aa, Homo sapiens; identical to SEQ ID NO: 841607

SEQ ID NO: 841621 - protein, 358 aa, Homo sapiens
MSVNDFHQVVEDHLHIRLHLCPHLECLSSVATALQSGFLPYCEPVYQRCVTLVQKTLAQAMVSNPRPVTCASALACLGPAPLTRAPVGICVQMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 841622 - protein, 211 aa, Homo sapiens; identical to SEQ ID NO: 841609

SEQ ID NO: 841623 - protein, 925 aa, Homo sapiens; identical to SEQ ID NO: 841607

SEQ ID NO: 841624 - protein, 925 aa, Homo sapiens; identical to SEQ ID NO: 841607

SEQ ID NO: 841625 - protein, 148 aa, Homo sapiens
MDWQPDEQGLQQVLQLLKDSQSPNTATQRIVQDKLKQLNQFPDFNNYLIFVLTRLKSEGTPSAPFHAIGTLLSPPGPLNLSLPPPDEPTRSLSGLILKNNVKAHYQSFPPPVADFIKQECLNNIGDASSLIRATIGERGSGGWPLRTH

SEQ ID NO: 841626 - protein, 58 aa, Homo sapiens
SHGWPERVLGGWDHHPPPTFVSLPLCTQGAFGALQKICEDSSELLDSDALNRPLNIMI

SEQ ID NO: 841627 - protein, 168 aa, Homo sapiens
LNFILFTQGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSDGEGRKRTSSTCSNESLSVGGTSVTPRRISWRQRIFLRVASPMNKSPSAMQQQGLCCTP

SEQ ID NO: 841628 - protein, 1218 aa, Homo sapiens
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSDGEGRKRTSSTCSNESLSVGGTSVTPRRISWRQRIFLRVASPMNKSPSAMQQQDGLDRNELLPLSPLSPTMEEEPLVIFLSGEDDPEKIEERKKSKELRSLWRKAIHQQILLLRMEKENQKLEVASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 841629 - protein, 1273 aa, Homo sapiens
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSNLSSVRRMYKESNSSSSLPSLHTSFSAPSFTAPSFLKSFYQNSGRLSPQYENEISDGEGRKRTSSTCSNESLSVGGTSVTPRRISWRQRIFLRVASPMNKSPSAMQQQDGLDRNELLPLSPLSPTMEEEPLVIFLSGEDDPEKIEERKKSKELRSLWRKAIHQQILLLRMEKENQKLEVASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 841630 - protein, 509 aa, Homo sapiens
MQQQDGLDRNELLPLSPLSPTMEEEPLVIFLSGEDDPEKIEERKKSKELRSLWRKAIHQQILLLRMEKENQKLEVASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 841631 - protein, 277 aa, Homo sapiens
MSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 841632 - protein, 1218 aa, Homo sapiens; identical to SEQ ID NO: 841628

SEQ ID NO: 841633 - protein, 1299 aa, Homo sapiens
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSNLSSVRRMYKESNSSSSLPSLHTSFSAPSFTAPSFLKSFYQNSGRLSPQYENEIRQDTASESSDGEGRKRTSSTCSNESLSVGGTSVTPRRISWRQRIFLRVASPMNKSPSAMQQQDGLDRNELLPLSPLSPTMEEEPLVIFLSGEDDPEKIEERKKSKELRSLWRKAIHQQILLLRMEKENQKLEVASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 841634 - protein, 1299 aa, Homo sapiens; identical to SEQ ID NO: 841633

SEQ ID NO: 841635 - protein, 1055 aa, Homo sapiens
MKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSDGEGRKRTSSTCSNESLSVGGTSVTPRRISWRQRIFLRVASPMNKSPSAMQQQDGLDRNELLPLSPLSPTMEEEPLVIFLSGEDDPEKIEERKKSKELRSLWRKAIHQQILLLRMEKENQKLEVASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 841636 - protein, 509 aa, Homo sapiens; identical to SEQ ID NO: 841630

SEQ ID NO: 841637 - protein, 57 aa, Homo sapiens
GDGLQLEYEMVLTNGKSFWTRHFSADEFGILETDVTFLLIFILIFFLSCYFGCESGT

SEQ ID NO: 841638 - protein, 57 aa, Homo sapiens
RLRIFWHQKALSKHREEERKKMKSGVQIKVLSLEDRQDILWDRREGEKAGEHADNTR

SEQ ID NO: 841639 - protein, 120 aa, Homo sapiens
MLLLLLAEHPSVMSTPSSPFLKSPSHFDLNAQCSFLRGSLFLASLLTLALTEQRHPYVSPESNSNHSLLELYQRLQARVPWAISSIFLSAPVLGPLGLGSSVLASCPPTLGIPIFTPYSV

SEQ ID NO: 841640 - protein, 1212 aa, Homo sapiens
AAMAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841641 - protein, 1178 aa, Homo sapiens
AAMAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841642 - protein, 1212 aa, Homo sapiens; identical to SEQ ID NO: 841640

SEQ ID NO: 841643 - protein, 1212 aa, Homo sapiens; identical to SEQ ID NO: 841640

SEQ ID NO: 841644 - protein, 1241 aa, Homo sapiens
AAMAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLWSPCPALDDPCPHFLQPQTLHWASCPLFRLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841645 - protein, 1038 aa, Homo sapiens
TGTTGPAECFKSARGMSNQEMDPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841646 - protein, 437 aa, Homo sapiens
MLLTRGADVTLTDNEENICLHWASFTGSAAIAEVLLNARCDLHAVNYHGDTPLHIAARESYHDCVLCSPCPALDDPCPHFLQPQTLHWASCPLFRLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841647 - protein, 253 aa, Homo sapiens
PEIKYFQRCKHLNLMQLTTCRNTVCSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841648 - protein, 815 aa, Homo sapiens
AAMAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQLLAAHAWGCCHLLSPPPFHTFLTRDPSQALEV

SEQ ID NO: 841649 - protein, 372 aa, Homo sapiens
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRE

SEQ ID NO: 841650 - protein, 206 aa, Homo sapiens
AAMAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQHTKTPSLKEV

SEQ ID NO: 841651 - protein, 73 aa, Homo sapiens
EDPPGVPVGEVQSLPQLLFSSIQGVSNDTSSLETERGFEELPLCSCRMEAPKIDRISERAGHKCMATESVDGE

SEQ ID NO: 841652 - protein, 1212 aa, Homo sapiens; identical to SEQ ID NO: 841640

SEQ ID NO: 841653 - protein, 1225 aa, Homo sapiens
AAMAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQGQLPPPSLPSHPQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841654 - protein, 1242 aa, Homo sapiens
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQVSTGPAPCLIHQALRPSPAPCLPGASPPAPSQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841655 - protein, 1219 aa, Homo sapiens
AAMAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNVSERLVEEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841656 - protein, 866 aa, Homo sapiens
VEGLALVGRRLTGDLGVRNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841657 - protein, 270 aa, Homo sapiens
MVDLQGLDCYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 841658 - protein, 861 aa, Homo sapiens
AAMAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHATPAGTELD

SEQ ID NO: 841659 - protein, 344 aa, Homo sapiens
AAMAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEAGSPLKTLFHTCTIGISSSCYC

SEQ ID NO: 841660 - protein, 204 aa, Homo sapiens
AAMAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQVSGMGEMG

SEQ ID NO: 841661 - protein, 575 aa, Homo sapiens
RRSLPAAIAHWGSGRLGPAWGSCAAGLWVLAPPEPTGHLVIPGTSPLEPPCPWLDSHIFQCRFGKMLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPEGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 841662 - protein, 510 aa, Homo sapiens
MLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPEGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 841663 - protein, 352 aa, Homo sapiens
RRSLPAAIAHWGSGRLGPAWGSCAAGLWVLAPPEPTGHLVIPGTSPLEPPCPWLDSHIFQCRFGKMLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPGEVGLNWC

SEQ ID NO: 841664 - protein, 314 aa, Homo sapiens
RRSLPAAIAHWGSGRLGPAWGSCAAGLWVLAPPEPTGHLVIPGTSPLEPPCPWLDSHIFQCRFGKMLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETPWLSPDPLFLEQRRVREAKTEEDGPANTEQGISFPSLTLPPGWTLRNSGWWKEIHKEAASQVRLG

SEQ ID NO: 841665 - protein, 288 aa, Homo sapiens
MRCRAAWEGQRCFQTAVSPAGIQSPEPCALFRQLRLGWVLLSLALGGALTQGSDLVPEGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 841666 - protein, 575 aa, Homo sapiens; identical to SEQ ID NO: 841661

SEQ ID NO: 841667 - protein, 575 aa, Homo sapiens; identical to SEQ ID NO: 841661

SEQ ID NO: 841668 - protein, 288 aa, Homo sapiens; identical to SEQ ID NO: 841665

SEQ ID NO: 841669 - protein, 245 aa, Homo sapiens
MALSVSSAGLWVLAPPEPTGHLVIPGTSPLEPPCPWLDSHIFQCRFGKMLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETRECPASLAASAGP

SEQ ID NO: 841670 - protein, 510 aa, Homo sapiens; identical to SEQ ID NO: 841662

SEQ ID NO: 841671 - protein, 290 aa, Homo sapiens
DLKSYRKLLLWGYQLSQEQFPHRSSSGQGYQLSQPDAASRLDTEELRLVERDPQGSSLPEGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 841672 - protein, 575 aa, Homo sapiens; identical to SEQ ID NO: 841661

SEQ ID NO: 841673 - protein, 262 aa, Homo sapiens
RRSLPAAIAHWGSGRLGPAWGSCAAGLWVLAPPEPTGHLVIPGTSPLEPPCPWLDSHIFQCRFGKMLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETRECPASLAASAGP

SEQ ID NO: 841674 - protein, 189 aa, Homo sapiens
MATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVNLEFSTFYKNTIAKFLQLSDMEMLC

SEQ ID NO: 841675 - protein, 102 aa, Homo sapiens
MATRRTGLSEGDGDKLKACEVSKNKDGKEQSETVSLSEDETFSWPGPKTVTLKRTSQGFGFTLRHFIVYPPESAIQFSYKVREIVTARKTKKPLGTNGYHIC

SEQ ID NO: 841676 - protein, 189 aa, Homo sapiens
MATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVVSFIYSYMSCFTVMNVRKIFLRWKY

SEQ ID NO: 841677 - protein, 189 aa, Homo sapiens; identical to SEQ ID NO: 841676

SEQ ID NO: 841678 - protein, 189 aa, Homo sapiens; identical to SEQ ID NO: 841676

SEQ ID NO: 841679 - protein, 79 aa, Homo sapiens
AERVPAGPGARPASPLQLAAALRPPGPSGREGISLGADTRTFTTHSDFSRTQEWHWEEGDRFLQLASTLAAKKTCRLCF

SEQ ID NO: 841680 - protein, 107 aa, Homo sapiens [sequence omitted]

SEQ ID NO: 841681 - protein, 97 aa, Homo sapiens
SFGGLRGVRTWRAWSWDLIREALSAVGAYLVTVALRSGTDTASLSGPHPRGLPAPLGLAQWRGASTTVEERHTQGPGCARLSAAVGASGRPPMGLSF

SEQ ID NO: 841682 - protein, 123 aa, Homo sapiens
SSEQKEPPEEAEPVAAAEPEVPENNGNNSWPHNDTEIANSTPNPKPAASSPETPSAGQQEAKTDQADGPREPPQSARRKRSYKQAVSELDEEQHLEDEELQPPRSKTPSSPCPASKVSQAPAL

SEQ ID NO: 841683 - protein, 361 aa, Homo sapiens
SSEQKEPPEEAEPVAAAEPEVPENNGNNSWPHNDTEIANSTPNPKPAASSPETPSAGQQEAKTDQADGPREPPQSARRKRSYKQAVSELDEEQHLEDEELQPPRSKTPSSPCPASKVVRPLRTFLHTVQRNQMLMTPTSAPRSVMKSFIKRNTPLRMDPKEKERQRLENLRRKEEAEQLRRQKVEEDKRRRLEEVKLKREERLRKVLQARERVEQMKEEKKKQIEQKFAQIDEKTEKAKEERLAEEKAKKKAAAKKMEEVEARRKQEEEARRLRWWLQQEEEERRHQELLQKKKEEEQERLRKAAEAKRLAEQREQERREQERREQERREQERREQERREQERQLAEQERRREQERLQAER

SEQ ID NO: 841684 - protein, 150 aa, Homo sapiens [sequence omitted]

SEQ ID NO: 841685 - protein, 57 aa, Homo sapiens
QAFERNNLIGWFGSDVLLGSNQLWPKSGVMENKYGAKSYPVDRMDTSGEARSSGAVE

SEQ ID NO: 841686 - protein, 198 aa, Homo sapiens
GKKERKEEGRKERGRKEGGEGRRERGRKEGGKGRKGEGRGGEGEKKGKRTSGYQGTETIRSPSLGRCRGSQPGTPTPAGCAPPLSPHPSPSSRHPAVHCSRSTGAPRGPLLETRQPSTHPHSVSLHPLFDMGAGALLEIRVYLRGLKTWAVGGCEALGRESACPRVWGSEWSGATRSDPIKVTFLGDISIAGSQKGKG

SEQ ID NO: 841687 - protein, 122 aa, Homo sapiens
VVVVPLAVSVACLNSDCHMATALPLGPGASVRPTTREGGRSQGPFLTGPELNTCPSHHSGSPHWDCHSGASQSTPPLEGEREENAALSSHSLKQTPTTLSLGSKWLSVDSFSQLSPLTGLNH

SEQ ID NO: 841688 - protein, 122 aa, Homo sapiens; identical to SEQ ID NO: 841687

SEQ ID NO: 841689 - protein, 75 aa, Homo sapiens
VVALSRILTPQAAVGEQGGSSPDWEPRRLDWMTCQGSPQGPANFPGDLEHSLFLDLGFSTCGAEGPAGLRHPLWL

SEQ ID NO: 841690 - protein, 159 aa, Homo sapiens
GPQAEALSAPGLTPIPLPPLLQVRYKEEFEKNKGKGFSVVADTPELQRIKKTQDQISNVSSCPALRHPCCPLFGPLPASLADASLADVNEASASTTPALQGGPGEELGVPRCLFSVYPQTTSTHSIFFLKGLYSVGACVLNQPPLSLTVVLFSGYRGYR

SEQ ID NO: 841691 - protein, 308 aa, Homo sapiens
NKKAQPFVHYAHGSSRLVLRPGYRDMMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKAGTGGGIDYKRRPTEGRRSYLSKGRVNTNRYNRGSSIRTTGLEWYRQPDGNRQHARTNGANPWHEDRTYSDGKAHTCETPQQRRPRKAGELSNERNTFSPPGEPFGTIPGDPL

SEQ ID NO: 841692 - protein, 215 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSRPHLSSAHSTASHPSWA

SEQ ID NO: 841693 - protein, 225 aa, Homo sapiens
MNPNCARCGKIVYPTEKVNCLDKFWHKACFHCETCKMTLNMKNYKGYEKKPYCNAHYPKQSFTMVADTPENLRLKQQSELQSQIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPANYVEAI

SEQ ID NO: 841694 - protein, 227 aa, Homo sapiens
TLTLTANPHPNRVTLTLTAYAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPANYVEAI

SEQ ID NO: 841695 - protein, 261 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPANYVEAI

SEQ ID NO: 841696 - protein, 140 aa, Homo sapiens
AKSSRGSTAWVRFLPAAGLQRAKSSRGSTAWVRFLPFLILGTATGRRGTRSSLPQPLSPRPPPVSRDPCLPPRLEAMVPKCRARVPQDLLVFSLPQPPGSGLGGRSSLLLMGRCLRAFHDLPSPAQCQVDLELHKVSRDH

SEQ ID NO: 841697 - protein, 137 aa, Homo sapiens
MARYEAGVESAPRPAPAAVAAACVVAAAAASRQLASGNRTRVSSGVPAPAFLGTMNPNCARCGKIVYPTEKVNCLDKFWHKACFHCETCNRVCSLLGLSGGGRLCHSRHMFPHLCLGLQNRVAEVSPCGCLPRGLFP

SEQ ID NO: 841698 - protein, 261 aa, Homo sapiens; identical to SEQ ID NO: 841695

SEQ ID NO: 841699 - protein, 261 aa, Homo sapiens; identical to SEQ ID NO: 841695

SEQ ID NO: 841700 - protein, 261 aa, Homo sapiens; identical to SEQ ID NO: 841695

SEQ ID NO: 841701 - protein, 261 aa, Homo sapiens; identical to SEQ ID NO: 841695

SEQ ID NO: 841702 - protein, 261 aa, Homo sapiens; identical to SEQ ID NO: 841695

SEQ ID NO: 841703 - protein, 261 aa, Homo sapiens; identical to SEQ ID NO: 841695

SEQ ID NO: 841704 - protein, 261 aa, Homo sapiens; identical to SEQ ID NO: 841695

SEQ ID NO: 841705 - protein, 261 aa, Homo sapiens; identical to SEQ ID NO: 841695

SEQ ID NO: 841706 - protein, 261 aa, Homo sapiens; identical to SEQ ID NO: 841695

SEQ ID NO: 841707 - protein, 261 aa, Homo sapiens; identical to SEQ ID NO: 841695

SEQ ID NO: 841708 - protein, 261 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLMMTWVGRCTAFSFLRLPFPSLPFPSVLPSFAPFLSSPSLSSIFLFFLHIICPRPPWPEINISCKSGFLQPIFQVGKLRHGPKVPQPHRGKQPPLNVTMHQSAWSS

SEQ ID NO: 841709 - protein, 152 aa, Homo sapiens
MNPNCARCGKIVYPTEKVNCLDKFWHKACFHCETCKKKKKKKRKKRGARRRRPTRRKKAREEKGKAQRDRARKDAEAAEREGGGGKPQGTSKRERTAEKSKRTSRQKAKEKREQKKRKTEAKERGEKGREDKKRGRSKEQDRRKRREEEEDP

SEQ ID NO: 841710 - protein, 91 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRGWAVLG

SEQ ID NO: 841711 - protein, 99 aa, Homo sapiens
WACSDDWLSAYSGDPIYDSLADASLADVNEASASTTPALQGGPGEELGVPRCLFSVYPQTTSTHSIFFLKGLYSVGACVLNQPPLSLTVVLFSGYRGYR

SEQ ID NO: 841712 - protein, 261 aa, Homo sapiens; identical to SEQ ID NO: 841695

SEQ ID NO: 841713 - protein, 235 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGNVQQIDDGWMYGTVERTGDTGMLPANYVEAI

SEQ ID NO: 841714 - protein, 289 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPCLCFLKPATACDSYPSSSFFCQLKPSSATSAGSLLWQASPLIDFLVFSLDGTGMGLSGGGRAGMGDLLACGPHLPLCSLPSHPPAQLLTYPHIPGLG

SEQ ID NO: 841715 - protein, 249 aa, Homo sapiens
TIQRRLAWPLRKDDTQIREAVPYLMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPANYVEAI

SEQ ID NO: 841716 - protein, 123 aa, Homo sapiens [sequence omitted]

SEQ ID NO: 841717 - protein, 261 aa, Homo sapiens; identical to SEQ ID NO: 841695

SEQ ID NO: 841718 - protein, 261 aa, Homo sapiens; identical to SEQ ID NO: 841695

SEQ ID NO: 841719 - protein, 261 aa, Homo sapiens; identical to SEQ ID NO: 841695

SEQ ID NO: 841720 - protein, 261 aa, Homo sapiens; identical to SEQ ID NO: 841695

SEQ ID NO: 841721 - protein, 261 aa, Homo sapiens; identical to SEQ ID NO: 841695

SEQ ID NO: 841722 - protein, 261 aa, Homo sapiens; identical to SEQ ID NO: 841695

SEQ ID NO: 841723 - protein, 261 aa, Homo sapiens; identical to SEQ ID NO: 841695

SEQ ID NO: 841724 - protein, 261 aa, Homo sapiens; identical to SEQ ID NO: 841695

SEQ ID NO: 841725 - protein, 261 aa, Homo sapiens; identical to SEQ ID NO: 841695

SEQ ID NO: 841726 - protein, 261 aa, Homo sapiens; identical to SEQ ID NO: 841695

SEQ ID NO: 841727 - protein, 261 aa, Homo sapiens; identical to SEQ ID NO: 841695

SEQ ID NO: 841728 - protein, 220 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNVSSCPALRHPCCPLFGPLPASLADASLADVNEASASTTPALQGGPGEELGVPRCLFSVYPQTTSTHSIFFLKGLYSVGACVLNQPPLSLTVVLFSGYRGYR

SEQ ID NO: 841729 - protein, 61 aa, Homo sapiens
PAFGDGEIGNRKKEGEEMAFCSPDARQPVRRRVKGTPPAVPGPPFHGAVASCWPGKRPAPP

SEQ ID NO: 841730 - protein, 72 aa, Homo sapiens
DILLSGLVVRIQRSHRRSPGSIPGHGTKKWSRTSRGQKYPTQPSWPASSTSPIVNQVLTDFSPLLSCSTYGQ

SEQ ID NO: 841731 - protein, 101 aa, Homo sapiens
LHTAGSPDMQLAPSVTVHTASSPDMQPAPSVTLHTASSPDMQPAPSVTLHTASSPDMQPAPSVTLHTASSPDMQPAPSVTLHTASSPDMQPAPSVTLHTAS

SEQ ID NO: 841732 - protein, 125 aa, Homo sapiens
MRKLQVGPPNAQAPQSTCWAESSPGEDSWGIYLLLLPAFPCPHHLRMPGTTLSPQSLCLGLCVCDRASAPLQVGSWEQAFLCPRPSTLGGEGTQDHRKVLSPPPGLHLCHSVNSQESFAGISPVT

SEQ ID NO: 841733 - protein, 220 aa, Homo sapiens
SLSWKPTENLHPLTPWSTPVVALCALTRAVAWRTAAAPAAARPPAAGPPAAAPAAVCPAAAGPSAASLCAVSPPAAAPAAVRPPAVGPPAAAPAAVCPAAADPSAASLCAASPPAAAPAAVRPPAAGPLAAAPAAVCPAAADPSAASLCAASPPAAAPAAASPAAAAPLAVNPAAAAPAAACVQSVAESPATPLAIAQPVSSPPAPAPCAVPPLAAKSLL

SEQ ID NO: 841734 - protein, 305 aa, Homo sapiens
CHHRGSPGSPVSAPPGSPGSPACHRRGRRGAPGLTNEVTWEPRGSPPRSPGSVTCVTRSPSVSHRSPRNSCHRQGHLEIRVTAEVPWEPRGCRTSAPALPPGSGSPRPPGLRAAAKPRVDRASAAASAGPRLAAASLYLRPPRGRCRSCRGRSSPARPFRVAAMPPAPRPGKQVRGSLGPCVGPWLAGDGPAPPRRGIACPRTQDPVREARAAGTGLSTLAMVGTKPHCALDTRSVLAATCRFQLVSMQGHGRHHRAICKKLSELSSPKTAAILLWFGIIGNMPFLKETVFQACSPSYSGGRGRS

SEQ ID NO: 841735 - protein, 69 aa, Homo sapiens
SGPRLSTRRHLSKSLPSGRNGSNLSLPNPHPIFPSNVTQARSKRKHLRYEYALTYMSVLVDIPRIHDSL

SEQ ID NO: 841736 - protein, 109 aa, Homo sapiens
SSPRAVRHSGHQDSKMASVGECPAPVPVKDKKLLEVKLGELPSWILMRDFSPSGIFGAFQRGYYRYYNKYINVKKGSISGITMVLACYVLFSYSFSYKHLKHERLRKYH

SEQ ID NO: 841737 - protein, 110 aa, Homo sapiens
MCYWEIIQWVFFLTLPFQLPVKDKKLLEVKLGELPSWILMRDFSPSGIFGAFQRGYYRYYNKYINVKKGSISGITMVLACYVLFSYSFSYKHLSECLCGVLPLVPMRGWW

SEQ ID NO: 841738 - protein, 133 aa, Homo sapiens
VAEVTLDYPSVSGASVTEHQKRSVSKRSNTTYPQQAGLRSDQDSKMASVVPVKDKKLLEVKLGELPSWILMRDFSPSGIFGAFQRGYYRYYNKYINVKKGSISGITMVLACYVLFSYSFSYKHLKHERLRKYH

SEQ ID NO: 841739 - protein, 94 aa, Homo sapiens
VAEVTLDYPSVSGASVTEHQKRSVSKRSNTTYPQQAGLRSDQDSKMASVVPVKDKKLLEVKLGELPSWILMRDFSPSGIFGAFQRGQSLVDVCK

SEQ ID NO: 841740 - protein, 109 aa, Homo sapiens; identical to SEQ ID NO: 841736

SEQ ID NO: 841741 - protein, 109 aa, Homo sapiens; identical to SEQ ID NO: 841736

SEQ ID NO: 841742 - protein, 103 aa, Homo sapiens
SSPRAVRHSGHQDSKMASVVPVKDKKLLEVKLGELPSWILMRDFSPSGIFGAFQRGYYRYYNKYINVKKGSISGITMVLACYVLFSYSFSYKHLKHERLRKYH

SEQ ID NO: 841743 - protein, 103 aa, Homo sapiens; identical to SEQ ID NO: 841742

SEQ ID NO: 841744 - protein, 94 aa, Homo sapiens; identical to SEQ ID NO: 841739

SEQ ID NO: 841745 - protein, 122 aa, Homo sapiens
VLPLKDGFSGAVCLSVCSLCSFWKESGWPGGRLAPEVSLCPPGLLILQRHRQAGHGSSLKGILRKALCDLSLLPAMLCLHCNLLRYLPSCLPDFRARAAPQIPLKRTHSAPPHPTTLARAPP

SEQ ID NO: 841746 - protein, 103 aa, Homo sapiens; identical to SEQ ID NO: 841742

SEQ ID NO: 841747 - protein, 109 aa, Homo sapiens; identical to SEQ ID NO: 841736

SEQ ID NO: 841748 - protein, 133 aa, Homo sapiens; identical to SEQ ID NO: 841738

SEQ ID NO: 841749 - protein, 109 aa, Homo sapiens; identical to SEQ ID NO: 841736

SEQ ID NO: 841750 - protein, 212 aa, Homo sapiens
QVEHQLEEEKKANNERQKAERVLEVQIQTLIIQKEELNTDLYHMERSLRYFEEESKDLAVRLQHSLQCKGELERALSAVIATEKKKANQLSSCSKAHTEWELEQSLQDQALLKAQLTQLKESFQQLQLERDECAEHIEGERARWHQRMSKMSQEICTLKKEKQDMRWVEQLEWSLSKLKNQTAEPLPPEPPAVPSEVELQHLRKELERVAGE

SEQ ID NO: 841751 - protein, 312 aa, Homo sapiens
DLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGGDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKVKFCRQFHEKTSALQEEADSIQRNELLLNQEVNKGVKEEIY

SEQ ID NO: 841752 - protein, 425 aa, Homo sapiens
MPVPWSWTSSLQNCPCHKRRASICCTQLGSLSALKHAVLGLYLLVFLILVGIFILAVSRPRSSPDDLKALTRNVNRLNESFRDLQLRLLQAPLQADLTEQVWKVQDALQNQSDSLLALAGAVQRLEGALWGLQAQAVQTEQAVALLRDRTGQQSDTAQLELYQLQVESNSSQLLLRRHAGLLDGLARRVGILGEELADVGGVLRGSTTACPTTWPPPHAAAGPAGAGEQRQRGHAPLRLAHVGMELQLKQELAMLNAVTEDLRLKDWEHSIALRNISLAKEGHRDPKVIRGMKERKAGLASLDCLDFEVCPGREVPQDVPGPKGDDGKLGATGPMGMRGFKGDRGPKGEKGEKGDRAGDASGVEAPMMIRLVNGSGPHEGRVEVYHDRRWGTVCDDGWDKKDGDVVCRMLGFRGVEEVYRTDEEP

SEQ ID NO: 841753 - protein, 377 aa, Homo sapiens
MANAEILRGQGSTASARGTQLLQGVMENKAMYLHTVSDCDTSSICEDSFDGRSLSKLNLCEDGPCHKRRASICCTQLGSLSALKHAVLGLYLLVFLILVGIFILAVSRPRSSPDDLKALTRNVNRLNESFRDLQLRLLQAPLQADLTEQVWKVQDALQNQSDSLLALAGAVQRLEGALWGLQAQAVQTEQAVALLRDRTGQQSDTAQLELYQLQVESNSSQLLLRRRLRLAHVGMELQLKQELAMLNAVTEDLRLKDWEHSIALRNISLAKAGPKGDDGKLGATGPMGMRGFKGDRGPKGEKGEKGDRAGDASGVEAPMMIRLVNGSGPHEGRVEVYHDRRWGTVCDDGWDKKDGDVVCRMLGFRGVEEVYRTDEEP

SEQ ID NO: 841754 - protein, 448 aa, Homo sapiens
MENKAMYLHTVSDCDTSSICEDSFDGRSLSKLNLCEDGPCHKRRASICCTQLGSLSALKHAVLGLYLLVFLILVGIFILAVSRPRSSPDDLKALTRNVNRLNESFRDLQLRLLQAPLQADLTEQVWKVQDALQNQSDSLLALAGAVQRLEGALWGLQAQAVQTEQAVALLRDRTGQQSDTAQLELYQLQVESNSSQLLLRRHAGLLDGLARRVGILGEELADVGGVLRGSTTACPTTWPPPHAAAGPAGAGEQRQRGHAPLRLAHVGMELQLKQELAMLNAVTEDLRLKDWEHSIALRNISLAKGPPGPKGDQGDEGKEGRPGIPGLPGLRGLPGERGTPGLPGPKGDDGKLGATGPMGMRGFKGDRGPKGEKGEKGDRAGDASGVEAPMMIRLVNGSGPHEGRVEVYHDRRWGTVCDDGWDKKDGDVVCRMLGFRGVEEVYRTDEEP

SEQ ID NO: 841755 - protein, 165 aa, Homo sapiens
MGDVLEQFFILTGLLVCLACLAKCVRFSRCVLLNYWKVLPKSFLRSMGQWAVITGAGDGIGKAYSFELAKRGLNVVLISRTLEKLEAIATEIERTTGRSVKIIQADFTKDDIYEHIKEKLAGLEIGILVNNVGMLPNLLPSHFLNAPDEIQHSIHSQEYHFSRYL

SEQ ID NO: 841756 - protein, 165 aa, Homo sapiens; identical to SEQ ID NO: 841755

SEQ ID NO: 841757 - protein, 165 aa, Homo sapiens; identical to SEQ ID NO: 841755

SEQ ID NO: 841758 - protein, 310 aa, Homo sapiens
MGDVLEQFFILTGLLVCLACLAKCVRFSRCVLLNYWKVLPKSFLRSMGQWAVITGAGDGIGKAYSFELAKRGLNVVLISRTLEKLEAIATEIERTTGRSVKIIQADFTKDDIYEHIKEKLAGLEIGILVNNVGMLPNLLPSHFLNAPDEIQSLIHCNITSVVKMTQLILKHMESRQKGLILNISSGIALFPWPLYSMYSASKAFVCAFSKALQEEYKAKEVIIQVLTPYAVSTAMTKYLNTNVITKTADEFVKESLNYVTIGGETCGCLAHEILAGFLSLIPAWAFYSGAFQRLLLTHYVAYLKLNTKVR

SEQ ID NO: 841759 - protein, 274 aa, Homo sapiens
MGDVLEQFFILTGLLVCLACLAKCVRFSRCVLLNYWKVLPKSFLRSMGQWAVITGAGDGIGKAYSFELAKRGLNVVLISRTLEKLEAIATEIVNNVGMLPNLLPSHFLNAPDEIQSLIHCNITSVVKMTQLILKHMESRQKGLILNISSGIALFPWPLYSMYSASKAFVCAFSKALQEEYKAKEVIIQVLTPYAVSTAMTKYLNTNVITKTADEFVKESLNYVTIGGETCGCLAHEILAGFLSLIPAWAFYSGAFQRLLLTHYVAYLKLNTKVR

SEQ ID NO: 841760 - protein, 165 aa, Homo sapiens; identical to SEQ ID NO: 841755

SEQ ID NO: 841761 - protein, 39 aa, Homo sapiens
KGGILAHAFGPGSGIGGDAHFDEDEFWTTHSGGGQNKQT

SEQ ID NO: 841762 - protein, 208 aa, Homo sapiens
MKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSG

SEQ ID NO: 841763 - protein, 31 aa, Homo sapiens
MGAGLSPPYRSQQGKSKPLPAPGVLHPEATV

SEQ ID NO: 841764 - protein, 100 aa, Homo sapiens
RLIETEKYNKREKRQGDRVKGTNGREKQIQRDGDTETENTEAQKSDRRKQRQIEQQETHGKIRCTKADKGRGRRKKKTGEKRQKQGEVGSYIKLQELWEH

SEQ ID NO: 841765 - protein, 59 aa, Homo sapiens [sequence omitted]

SEQ ID NO: 841766 - protein, 1237 aa, Homo sapiens
MLPYTVNFKVSARTLTGALNAHNKAAVDWLRTPSFQVARIGQGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIHPPNYIVLWNADTGTKLWKKSYADNILSFSFDPFDPSHLTLLTSEGIVFISDFSPSKPPSGPGKKVYISSPHSSPAHNKLATATGAKKALNKVKILITQEKPSAEFITLNDCLQLAYLPSKRNHMLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGRSIAFRGERGNDESAIEMIKVSHLKQYLAVVFRDKPLELWDVRTCTLLREMSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKEVQMVSSLRSGRNVTFRILDVDWCTSDKVILASDDGCIRVLEMSMKSACFRMDEQELTEPVWCPYLLVPRASLALKAFLLHQPWNGQYSLDISHVDYPENEEIKNLLQEQLNSLSNDIKKLLLDPEFTLLQRCLLVSRLYGDESELHFWTVAAHYLHSLSQEKSASTTAPKEAAPRDKLSNPLDICYDVLCENAYFQKFQLERVNLQEVKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHSMRYFDRAALFVEACLKYGAFEVTEDTEKLITAIYADYARSLKNLGFKQGAVLFASKAGAAGKDLLNELESPKEEPIEE

SEQ ID NO: 841767 - protein, 965 aa, Homo sapiens
MLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGRSIAFRGERGNDESAIEMIKVSHLKQYLAVVFRDKPLELWDVRTCTLLREMSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKEVQMVSSLRSGRNVTFRILDVDWCTSDKVILASDDGCIRVLEMSMKSACFRMDEQELTEPVWCPYLLVPRASLALKAFLLHQPWNGQYSLDISHVDYPENEEIKNLLQEQLNSLSNDIKKLLLDPEFTLLQRCLLVSRLYGDESELHFWTVAAHYLHSLSQEKSASTTAPKEAAPRDKLSNPLDICYDVLCENAYFQKFQLERVNLQEVKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHSMRYFDRAALFVEACLKYGAFEVTEDTEKLITAIYADYARSLKNLGFKQGAVLFASKAGAAGKDLLNELESPKEEPIEE

SEQ ID NO: 841768 - protein, 619 aa, Homo sapiens
MSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKEVQMVSSLRSGRNVTFRILDVDWCTSDKVILASDDGCIRVLEMSMKSACFRMDEQELTEPVWCPYLLVPRASLALKAFLLHQPWNGQYSLDISHVDYPENEEIKNLLQEQLNSLSNDIKKLLLDPEFTLLQRCLLVSRLYGDESELHFWTVAAHYLHSLSQEKSASTTAPKEAAPRDKLSNPLDICYDVLCENAYFQKFQLERVNLQEVKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHSMRYFDRAALFVEACLKYGAFEVTEDTEKLITAIYADYARSLKNLGFKQGAVLFASKAGAAGKDLLNELESPKEEPIEE

SEQ ID NO: 841769 - protein, 1206 aa, Homo sapiens
MLPYTVNFKVSARTLTGALNAHNKAAVDWGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIHPPNYIVLWNADTGTKLWKKSYADNILSFSFDPFDPSHLTLLTSEGIVFISDFSPSKPPSGPGKKVYISSPHSSPAHNKLATATGAKKALNKVKILITQEKPSAEFITLNDCLQLAYLPSKRNHMLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGRSIAFRGERGNDESAIEMIKVSHLKQYLAVVFRDKPLELWDVRTCTLLREMSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKEVQMVSSLRSGRNVTFRILDVDWCTSDKVILASDDGCIRVLEMSMKSACFRMDEQELTEPVWCPYLLVPRASLALKAFLLHQPWNGQYSLDISHVDYPENEEIKNLLQEQLNSLSNDIKKLLLDPEFTLLQRCLLVSRLYGDESELHFWTVAAHYLHSLSQEKSASTTAPKEAAPRDKLSNPLDICYDVLLKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHSMRYFDRAALFVEACLKYGAFEVTEDTEKLITAIYADYARSLKNLGFKQGAVLFASKAGAAGKDLLNELESPKEEPIEE

SEQ ID NO: 841770 - protein, 797 aa, Homo sapiens
MLPYTVNFKVSARTLTGALNAHNKAAVDWGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIHPPNYIVLWNADTGTKLWKKSYADNILSFSFDPFDPSHLTLLTSEGIVFISDFSPSKPPSGPGKKVYISSPHSSPAHNKLATATGAKKALNKVKILITQEKPSAEFITLNDCLQLAYLPSKRNHMLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGRSIAFRGERGNDESAIEMIKVSHLKQYLAVVFRDKPLELWDVRTCTLLREMSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKESLCGAPISLFQGPLLP

SEQ ID NO: 841771 - protein, 1224 aa, Homo sapiens
MLPYTVNFKVSARTLTGALNAHNKAAVDWGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIHPPNYIVLWNADTGTKLWKKSYADNILSFSFDPFDPSHLTLLTSEGIVFISDFSPSKPPSGPGKKVYISSPHSSPAHNKLATATGAKKALNKVKILITQEKPSAEFITLNDCLQLAYLPSKRNHMLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGRSIAFRGERGNDESAIEMIKVSHLKQYLAVVFRDKPLELWDVRTCTLLREMSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKEVQMVSSLRSGRNVTFRILDVDWCTSDKVILASDDGCIRVLEMSMKSACFRMDEQELTEPVWCPYLLVPRASLALKAFLLHQPWNGQYSLDISHVDYPENEEIKNLLQEQLNSLSNDIKKLLLDPEFTLLQRCLLVSRLYGDESELHFWTVAAHYLHSLSQEKSASTTAPKEAAPRDKLSNPLDICYDVLCENAYFQKFQLERVNLQEVKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHSMRYFDRAALFVEACLKYGAFEVTEDTEKLITAIYADYARSLKNLGFKQGAVLFASKAGAAGKDLLNELESPKEEPIEE

SEQ ID NO: 841772 - protein, 1224 aa, Homo sapiens; identical to SEQ ID NO: 841771

SEQ ID NO: 841773 - protein, 117 aa, Homo sapiens [sequence omitted]

SEQ ID NO: 841774 - protein, 566 aa, Homo sapiens
MLPYTVNFKVSARTLTGALNAHNKAAVDWGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIHPPNYIVLWNADTGTKLWKKSYADNILSFSFDPFDPSHLTLLTSEGIVFISDFSPSKPPSGPGKKVYISSPHSSPAHNKLATATGAKKALNKVKILITQEKPSAEFITLNDCLQLAYLPSKRNHMLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGLFLKIQIGLSY

SEQ ID NO: 841775 - protein, 565 aa, Homo sapiens
MLPYTVNFKVSARTLTGALNAHNKAAVDWGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIHPPNYIVLWNADTGTKLWKKSYADNILSFSFDPFDPSHLTLLTSEGIVFISDFSPSKPPSGPGKKVYISSPHSSPAHNKLATATGAKKALNKVKILITQEKPSAEFITLNDCLQLAYLPSKRNHMLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGLFLKIQIGLS

SEQ ID NO: 841776 - protein, 1224 aa, Homo sapiens; identical to SEQ ID NO: 841771

SEQ ID NO: 841777 - protein, 1111 aa, Homo sapiens
MLPYTVNFKVSARTLTGALNAHNKAAVDWGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIHPPNYIVLWNADTGTKLWKKSYADNILSFSFDPFDPSHLTLLTSEGIVFISDFSPSKPPSGPGKKVYISSPHSSPAHNKLATATGAKKALNKVKILITQEKPSAEFITLNDCLQLAYLPSKRNHMLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMNGNSSLQFVIEIHGTGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGRSIAFRGERGNDESAIEMIKVSHLKQYLAVVFRDKPLELWDVRTCTLLREMSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKEVQMVSSLRSGRNVTFRILDVDWCTSDKVILASDDGCIRVLEMSMKSACFRMDEQELTEPVWCPYLLVPRASLALKAFLLHQPWNGQYSLDISHVDYPENEEIKNLLQEQLNSLSNDIKKLLLDPEFTLLQRCLLVSRLYGDESELHFWTVAAHYLHSLSQEKSASTTAPKEAAPRDKLSNPLDICYDVLCENAYFQKFQLERVNLQEVKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHR

SEQ ID NO: 841778 - protein, 645 aa, Homo sapiens
GIRLVDLSSLQQQQIYRSTTCTLLREMSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKEVQMVSSLRSGRNVTFRILDVDWCTSDKVILASDDGCIRVLEMSMKSACFRMDEQELTEPVWCPYLLVPRASLALKAFLLHQPWNGQYSLDISHVDYPENEEIKNLLQEQLNSLSNDIKKLLLDPEFTLLQRCLLVSRLYGDESELHFWTVAAHYLHSLSQEKSASTTAPKEAAPRDKLSNPLDICYDVLCENAYFQKFQLERVNLQEVKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHSMRYFDRAALFVEACLKYGAFEVTEDTEKLITAIYADYARSLKNLGFKQGAVLFASKAGAAGKDLLNELESPKEEPIEE

SEQ ID NO: 841779 - protein, 797 aa, Homo sapiens; identical to SEQ ID NO: 841770

SEQ ID NO: 841780 - protein, 285 aa, Homo sapiens
HEVCLEEQLLEELLCWLTFPGISCAGSGQRQSRSAYFQKFQLERVNLQEVKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHSMRYFDRAALFVEACLKYGAFEVTEDTEKLITAIYADYARSLKNLGFKQGAVLFASKAGAAGKDLLNELESPKEEPIEE

SEQ ID NO: 841781 - protein, 1224 aa, Homo sapiens; identical to SEQ ID NO: 841771

SEQ ID NO: 841782 - protein, 566 aa, Homo sapiens; identical to SEQ ID NO: 841774

SEQ ID NO: 841783 - protein, 68 aa, Homo sapiens
SAPRSWAGRRDVALHSELQGVGAHPHGGPQRPQQGGGGLVRTPSFQVARIGQECVRGKGEGQEVSPPG

SEQ ID NO: 841784 - protein, 128 aa, Homo sapiens
LDFSSCVMKFPPDFQRPFQACKRFDSHPSVPTKPPGQPDPRVGRKRLHQGALWELRSSWGFVAWSDLCTGIFSCQARPRPLPGTGQTPSLMHLCPLRLPSPRMAHPSGPSSLSSSFQGLIPQGCPLFW

SEQ ID NO: 841785 - protein, 135 aa, Homo sapiens
MAPEHSWSFGVSPATRERERDMRPFQACKRFDSHPSVPTKPPGQPDPRVGRKRLHQGALWELRSSWGFVAWSDLCTGIFSCQARPRPLPGTGQTPSLMHLCPLRLPSPRMAHPSGPSSLSSSFQGLIPQGCPLFW

SEQ ID NO: 841786 - protein, 111 aa, Homo sapiens [sequence omitted]

SEQ ID NO: 841787 - protein, 109 aa, Homo sapiens
ERQSHSVAQAGVQWHNLSSLQPPPPRFKQFSCLSLQSSWNYKCPPPRPANFFCILVEKGFHHVVQAGLKLLSSGNLPASASQRAGITGMSHCAQHSLSFEAAQSTQLLS

SEQ ID NO: 841788 - protein, 103 aa, Homo sapiens
NKCQEVATHTLKKNSEPLYPTFAFSGVIGLAHTHVNRADVSHFWAKEFKKWGLSPLHSLFPLLPALIPQGMSEYGTEGARTSTLHCSGRKKYIFWPAQGGSRL

SEQ ID NO: 841789 - protein, 86 aa, Homo sapiens
QGHPLSKMYSLDISHSMPTSIFPTTLGINYQTIFSDTEKGVASSINTALSTSKPSGILQYVASLAPVNVPVLQMRKWRLLEEVREI

SEQ ID NO: 841790 - protein, 116 aa, Homo sapiens
MTPQYIPKHPNTHTITHTHTHSYHTLSISTPYPTPTLPDTPRTQLQPCYLPTDSYPQSPDTSPDTHTLPTAPNVSPSYSSALPQTPVSSPIPFQTYSLPLQHTYTHCFKHPLKQEH

SEQ ID NO: 841791 - protein, 142 aa, Homo sapiens
RFSSVSLCAQGLAESSWVEWRQLGGMGSCLNSVSLEVLHGGQPCHPPDSCFYLQASSPANLPICPLPLSRPTYLGPISAQPLRAVCCLLFMTFCSQLLAFAHASSHLEISLEQLRVALMQEIHMGAIQAAQLWVHWAPAAPT

SEQ ID NO: 841792 - protein, 212 aa, Homo sapiens
NELLTEQVHKARVKFNTLKGKLRETRDALREKTLALESVQLDLKQAQHRIKEMKQMHPNGEAKESQSIGKQNSSEERIRQRELENLLLERQLEDARKEGDNKEIVINIHRDCLENGKEDLLEERNKELMNEYNYLKEKLLQYEKEKAEREVIVREFQEELVDHLKKFSMSESPLEGTSHCHINLDETWTSKKKLFQVEIQPEEKHEEFRKVF

SEQ ID NO: 841793 - protein, 285 aa, Homo sapiens
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQDIKPYSCEQCGKVFRRNCDLRRHSLTHTPRQDF

SEQ ID NO: 841794 - protein, 107 aa, Homo sapiens
QLQVVYEHRSRLEKSLQKERLEHKKAKEDFLVYKLEAQETLNKGRQDSNSRYSALNVQHQMLKSQHEELKKQHSDLEEEHRKQGEDFSRTFNDHKQKYLLWDLVGCT

SEQ ID NO: 841795 - protein, 237 aa, Homo sapiens
MHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQDIKPYSCEQCGKVFRRNCDLRRHSLTHTPRQDF

SEQ ID NO: 841796 - protein, 267 aa, Homo sapiens
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQSRTCSSRELTLLLGD

SEQ ID NO: 841797 - protein, 312 aa, Homo sapiens
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQESPHKCPTCGRTFNQRSNLKTHLLTHTDIKPYSCEQCGKVFRRNCDLRRHSLTHTPRQDF

SEQ ID NO: 841798 - protein, 50 aa, Homo sapiens
VHPGARKMKEKWENDKDVAMSFHYISMGDCIGWLEDFLMGMDSTLEPSAG

SEQ ID NO: 841799 - protein, 191 aa, Homo sapiens
LPWGPSKRKMAQEKSLGGASQLALWRPFPACGERLSATPPGPATSQPLPGVRPQGMSKKPQKPKHSSPGKKPAGRKTRSPRLWREKIMTQIEMRSQGPNFPHTGQDCLAYPRIVENSAVATPTSELPKFWGLQSPLPTAWEASCPDAMHPLVTGSHLSIPQDRKGSNSPREPRAVLGASGCRGKLRTLETN

SEQ ID NO: 841800 - protein, 177 aa, Homo sapiens
LPWGPSKRKMAQEKSLGGASQLALWRPFPACGERLSATPPGPATSQPLPGVRPQGMSKKPQKPKHSSPGKKPAGRKTRSPRLWREKIMTQIEMRSQGPNFPHTGQDCLAYPRIVENSAVATPTSELPKFWGLQSPLPTAWEASCPDAMHPLVTGSHLSIPQDRKGSNSPREPRAVLG

SEQ ID NO: 841801 - protein, 139 aa, Homo sapiens
HPQETVEALGALAWPGCRLHGRAGRCLLSQLPRLSAASRSPTQGWGSVPPTHTRRLPQEEQAGPRAAGWAAGRSDLAGESAIPAIASDKLGLLWPQHRFNTHCAMCQLLHTHLHTQLTGSKAGKEGTGPRPHRCCELGL

SEQ ID NO: 841802 - protein, 136 aa, Homo sapiens
AAARTVAAQGLRGLLGGHTAGPGRGVSLQGAPQAQGPSGDSTVTRPAGGSQFCVSGARSTDSTLTALCASCCTLTSTPNSQEARLGRRELAPGHTDAASWDYDRVQWLTPVIPALGEAKASGLLEPRSLRPAWATW

SEQ ID NO: 841803 - protein, 146 aa, Homo sapiens
AAARTVAAQGLRGLLGGHTAGPGRGVSLQGAPQAQGPSGDSTVTRPAGGSQFCVSGARSTGWVGAGAGAAEVGKAWGAQALGVESRQEAPVGTTPGPRLPPVLPPTHGHGHQEQRDLGSPRDSAGRAQTSGVRAREGQLPASCFLG

SEQ ID NO: 841804 - protein, 158 aa, Homo sapiens
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKRQQWQWIDGAMYLYRSWSGKSMGGNKHCAEMSSNNNFLTWSSNECNKRQHFLCKYRP

SEQ ID NO: 841805 - protein, 158 aa, Homo sapiens; identical to SEQ ID NO: 841804

SEQ ID NO: 841806 - protein, 119 aa, Homo sapiens
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKPSHSTPACFSFGHRKVYQ

SEQ ID NO: 841807 - protein, 158 aa, Homo sapiens; identical to SEQ ID NO: 841804

SEQ ID NO: 841808 - protein, 74 aa, Homo sapiens
RDIHFSIEVRLQEDPLKRQQWQWIDGAMYLYRSWSGKSMGGNKHCAEMSSNNNFLTWSSNECNKRQHFLCKYRP

SEQ ID NO: 841809 - protein, 487 aa, Homo sapiens
AIAAMASLLWGGDAGAAESERLNSHFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFNSSIKQLNAEDMDEIEKIDY

SEQ ID NO: 841810 - protein, 487 aa, Homo sapiens; identical to SEQ ID NO: 841809

SEQ ID NO: 841811 - protein, 476 aa, Homo sapiens
KGGIVVLRYNNRKKFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFNSSIKQLNAEDMDEIEKIDY

SEQ ID NO: 841812 - protein, 487 aa, Homo sapiens; identical to SEQ ID NO: 841809

SEQ ID NO: 841813 - protein, 79 aa, Homo sapiens
FLCLPVELLAPRHGGLGIRSQWPYAGGWSRGSAARLAAVVGSDGDRSAAGAMCQVVPVPANHLPVGSTVNTVHLSSDGT

SEQ ID NO: 841814 - protein, 79 aa, Homo sapiens; identical to SEQ ID NO: 841813

SEQ ID NO: 841815 - protein, 79 aa, Homo sapiens; identical to SEQ ID NO: 841813

SEQ ID NO: 841816 - protein, 147 aa, Homo sapiens
EKEGNSTAIKAVLKGIVQLLKTILRLHISQWSTSPDLRVSLRTAIMKPSGLTGMSLPLLENQIKNRECVPLQNVIQAGRKGSCILEECSKNKCKITVAGTGQGMGQEAGPLQTIGPWQPPKIGQKCTCRMRSCDHLSLKDSVLFQLE

SEQ ID NO: 841817 - protein, 247 aa, Homo sapiens
HFKSILERHRIIHTEEKPYKCNECGKTFRQKSILTRHHRLHTGEKPYKCNECGKTFSHKSSLTCHHRLHTGEKPYKCNECGKTFSHKSSLTCHRRLHTGEKPYKCEECDKAYSFRSNFEIHRKIHTEDNAYKCNECGKTFSRTSSLTCHRRRHTGEQPYKCEECDKAFRFKSNLERHRRIHTGEKPYKCNECGKTFSRKSYLTCHHRLHTGEKAYKCNECGKTFSWKSSLTCHRRLHSGEKPYKCKE

SEQ ID NO: 841818 - protein, 128 aa, Homo sapiens
CPVCGALFWQPALTHKPTSDLGPDWVQAYTAWPAQPLSAFTASCSFHCSGILILAFLVGHCSPDHFIWAGMRRQGGPQGHSCPSAVLPYLSYPLDHAKCLSYAVFCSLVNAYNRHILSIHDVPAAPQL

SEQ ID NO: 841819 - protein, 124 aa, Homo sapiens
LTLILSYPQYRLPQLIILLLTSKMPSLPSPYIPLPSPFLPLLGLTLTPTSPNNSPGPSCPKVSETAHTTLARPSPVTCFLFVHLFPISFNMWMTFFFAAPLTNPPSKTLSCFFNTSTPRGTEYP

SEQ ID NO: 841820 - protein, 174 aa, Homo sapiens
TVKTTDTRGGSPKTSASLGLGTSLRTVGSWLKDLGSPEAATEPRTTSVQKSNHLVLYSAARDNHILLLLHPKAPMESSDVELDLQRSVQAVLRELSTQAPALQSNQGMWRWSLHKKVERDPGKSPVLVRILLRELEKVSSWTSGRKTGMKGREGPIGQGLSPGSAISHKLWLPA

SEQ ID NO: 841821 - protein, 71 aa, Homo sapiens
SILRACAHPLNISVMRTYCVPGTVLSAGEALLSWGLQSRTQVITTQIKGKTTLSSGALQNRSVELMELIGA

SEQ ID NO: 841822 - protein, 91 aa, Homo sapiens
CFRNNLTARYEAGWCERWASLGTTGTSAAKPGARESPTTRSGSMSWGAQLPTPRFGPRRIHTVRVRGGNKKYRALRLDRGEFLLGLRVLYS

SEQ ID NO: 841823 - protein, 91 aa, Homo sapiens; identical to SEQ ID NO: 841822

SEQ ID NO: 841824 - protein, 69 aa, Homo sapiens
KKKTEASGGRVLIGRGRAMGISRDNWHKRRKTGGKRKPYHKKRKYELGRPAANTKIWPPPHPHSPCAGR

SEQ ID NO: 841825 - protein, 141 aa, Homo sapiens
MEPKAAGGRSLYTHRIKKKTPRGGGQHRDALSWEDTQLPHKEREGSLERGDYIAGGALYNTKEGGEFPKEAGRRAKYISEKYMRPPGQFRGGSTRYAKTREHTTNDKPHSKKTTKQKRKKSKNIRSTKQKKETSRQNNKLK

SEQ ID NO: 841826 - protein, 82 aa, Homo sapiens
AARANYGCEKRQKGKTRIIDVVYNASNNELVRTKTLVKNCIVLIDSTPYRQWYESHYALPLGRKKGAKLTPEEEEILNKKTI

SEQ ID NO: 841827 - protein, 39 aa, Homo sapiens
MRPGSNTCFSATHVLGTKGDKLGGTLRGRIIILKGRVHL

SEQ ID NO: 841828 - protein, 32 aa, Homo sapiens
MFGPPRRNARQNAKRSPNRRGNPVVVHATPLP

SEQ ID NO: 841829 - protein, 91 aa, Homo sapiens; identical to SEQ ID NO: 841822

SEQ ID NO: 841830 - protein, 91 aa, Homo sapiens; identical to SEQ ID NO: 841822

SEQ ID NO: 841831 - protein, 91 aa, Homo sapiens; identical to SEQ ID NO: 841822

SEQ ID NO: 841832 - protein, 91 aa, Homo sapiens; identical to SEQ ID NO: 841822

SEQ ID NO: 841833 - protein, 91 aa, Homo sapiens; identical to SEQ ID NO: 841822

SEQ ID NO: 841834 - protein, 91 aa, Homo sapiens; identical to SEQ ID NO: 841822

SEQ ID NO: 841835 - protein, 91 aa, Homo sapiens; identical to SEQ ID NO: 841822

SEQ ID NO: 841836 - protein, 91 aa, Homo sapiens; identical to SEQ ID NO: 841822

SEQ ID NO: 841837 - protein, 91 aa, Homo sapiens; identical to SEQ ID NO: 841822

SEQ ID NO: 841838 - protein, 91 aa, Homo sapiens; identical to SEQ ID NO: 841822

SEQ ID NO: 841839 - protein, 91 aa, Homo sapiens; identical to SEQ ID NO: 841822

SEQ ID NO: 841840 - protein, 91 aa, Homo sapiens; identical to SEQ ID NO: 841822

SEQ ID NO: 841841 - protein, 91 aa, Homo sapiens; identical to SEQ ID NO: 841822

SEQ ID NO: 841842 - protein, 91 aa, Homo sapiens; identical to SEQ ID NO: 841822

SEQ ID NO: 841843 - protein, 91 aa, Homo sapiens; identical to SEQ ID NO: 841822

SEQ ID NO: 841844 - protein, 91 aa, Homo sapiens; identical to SEQ ID NO: 841822

SEQ ID NO: 841845 - protein, 91 aa, Homo sapiens; identical to SEQ ID NO: 841822

SEQ ID NO: 841846 - protein, 91 aa, Homo sapiens; identical to SEQ ID NO: 841822

SEQ ID NO: 841847 - protein, 88 aa, Homo sapiens
CFRNNLTARYEAGWCERWASLGTTGTSAAKPGARESPTTRSGSMSWGAQLPTPRFGPRRIHTVRVRGGNKKYRALRLDRGEFLLGLRV

SEQ ID NO: 841848 - protein, 88 aa, Homo sapiens; identical to SEQ ID NO: 841847

SEQ ID NO: 841849 - protein, 91 aa, Homo sapiens; identical to SEQ ID NO: 841822

SEQ ID NO: 841850 - protein, 89 aa, Homo sapiens
RPLLLLNWGRSDAERWASLGTTGTSAAKPGARESPTTRSGSMSWGAQLPTPRFGPRRIHTVRVRGGNKKYRALRLDRGEFLLGLRVLYS

SEQ ID NO: 841851 - protein, 94 aa, Homo sapiens
MSWGAQLPTPRFGPRRIHTVRVRGGNKKYRALRLDVGNFSWGSECCTRKTRIIDVVYNASNNELVRTKTWERFHLSRRPPNAVDRHYASRTKRS

SEQ ID NO: 841852 - protein, 91 aa, Homo sapiens; identical to SEQ ID NO: 841822

SEQ ID NO: 841853 - protein, 91 aa, Homo sapiens; identical to SEQ ID NO: 841822

SEQ ID NO: 841854 - protein, 91 aa, Homo sapiens; identical to SEQ ID NO: 841822

SEQ ID NO: 841855 - protein, 91 aa, Homo sapiens; identical to SEQ ID NO: 841822

SEQ ID NO: 841856 - protein, 91 aa, Homo sapiens; identical to SEQ ID NO: 841822

SEQ ID NO: 841857 - protein, 91 aa, Homo sapiens; identical to SEQ ID NO: 841822

SEQ ID NO: 841858 - protein, 91 aa, Homo sapiens; identical to SEQ ID NO: 841822

SEQ ID NO: 841859 - protein, 91 aa, Homo sapiens; identical to SEQ ID NO: 841822

SEQ ID NO: 841860 - protein, 91 aa, Homo sapiens; identical to SEQ ID NO: 841822

SEQ ID NO: 841861 - protein, 91 aa, Homo sapiens; identical to SEQ ID NO: 841822

SEQ ID NO: 841862 - protein, 91 aa, Homo sapiens; identical to SEQ ID NO: 841822

SEQ ID NO: 841863 - protein, 81 aa, Homo sapiens
ISSVPPPYPWGISPGAQSVVLVKQGIIDVVYNASNNELGSYQDPWVKNCIVLIDSTPYRQWYESHFMRCPWAAKKGAKLDS

SEQ ID NO: 841864 - protein, 88 aa, Homo sapiens; identical to SEQ ID NO: 841847

SEQ ID NO: 841865 - protein, 91 aa, Homo sapiens; identical to SEQ ID NO: 841822

SEQ ID NO: 841866 - protein, 50 aa, Homo sapiens
MASGRSWVGRKTFVTPGRPFEKSRLDHNLKLIGEYVPRNKREVGGVNFPW

SEQ ID NO: 841867 - protein, 91 aa, Homo sapiens; identical to SEQ ID NO: 841822

SEQ ID NO: 841868 - protein, 37 aa, Homo sapiens
KIKQAEKYFHLLSTKFTTHFIYAHILAFIFVTKDEHF

SEQ ID NO: 841869 - protein, 111 aa, Homo sapiens [sequence omitted]

SEQ ID NO: 841870 - protein, 658 aa, Homo sapiens
SSSLKINCLHIAFFAPKLFPLVVLRGDAQGAPPFKNWIMNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGHEGYVPSSYLVEKSPNNLETYEWYNKSISRDKAEKLLLDTGKEGAFMVRDSRTAGTYTVSVFTKAVVSENNPCIKHYHIKETNDNPKRYYVAEKYVFDSIPLLINYHQHNGGGLVTRLRYPVCFGRQKAPVTAGLRYGKWVIDPSELTFVQEIGSGQFGLVHLGYWLNKDKVAIKTIREGAMSEEDFIEEAEVMMKLSHPKLVQLYGVCLEQAPICLVFEFMEHGCLSDYLRTQRGLFAAETLLGMCLDVCEGMAYLEEACVIHRDLAARNCLVGENQVIKVSDFGMTRFVLDDQYTSSTGTKFPVKWASPEVFSFSRYSSKSDVWSFGVLMWEVFSEGKIPYENRSNSEVVEDISTGFRLYKPRLASTHVYQIMNHCWKERPEDRPAFSRLLRQLAEIAESGL

SEQ ID NO: 841871 - protein, 620 aa, Homo sapiens
MNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGHEGYVPSSYLVEKSPNNLETYEWYNKSISRDKAEKLLLDTGKEGAFMVRDSRTAGTYTVSVFTKAVVSENNPCIKHYHIKETNDNPKRYYVAEKYVFDSIPLLINYHQHNGGGLVTRLRYPVCFGRQKAPVTAGLRYGKWVIDPSELTFVQEIGSGQFGLVHLGYWLNKDKVAIKTIREGAMSEEDFIEEAEVMMKLSHPKLVQLYGVCLEQAPICLVFEFMEHGCLSDYLRTQRGLFAAETLLGMCLDVCEGMAYLEEACVIHRDLAARNCLVGENQVIKVSDFGMTRFVLDDQYTSSTGTKFPVKWASPEVFSFSRYSSKSDVWSFGVLMWEVFSEGKIPYENRSNSEVVEDISTGFRLYKPRLASTHVYQIMNHCWKERPEDRPAFSRLLRQLAEIAESGL

SEQ ID NO: 841872 - protein, 223 aa, Homo sapiens
MKFVPCLLLVTLSCLGTLGQAPRQKQGSTGEEFHFQTGGRDSCTMRPSSLGQGAGEVWLRVDCRNTDQTYWCEYRGQPSMCQAFAADPKPYWNQALQELRRLHHACQGAPVLRPSVCREAGPQAHMQQVTSSLKGSPEPNQQPEAGTPSLRPKATVKLTEATQLGKDSMEELGKAKPTTRPTAKPTQPGPRPGGNEEAKKKAWEHCWKPFQALCAFLISFFRG

SEQ ID NO: 841873 - protein, 372 aa, Homo sapiens
GDRPRRASAAEGRPSKEGFSGRGETIQGSEWGLKFSLKFWPTSVSKVPPFKGLSILTLPPAATSTWAPRSRSSSLPDFPLAHPVQSQPGLSAHMAPAHQHSGALHQSLTPLPTLQFQDVTGPSFLPQALHQQYLLQQQLLEAQHRRLVSHPRRSQERVSVHPHRLHPSFDFGQLQTPQPRYLAEGTDWDLSVDAGLSPAQFQVRPIPQHYQHYLATPRMHHFPRNSSSTQMVVHEIRNYPYPQLHFLALQGLNPSRHTSAVRESYEELLQLEDRLGNVTRGAVQNTIERFTFPHKYKKRRPQDGKGKKDEGEESDTDEKCTICLSMLEDGEDVRRLPCMHLFHQLCVDQWLAMSKKCPICRVDIETQLGADS

SEQ ID NO: 841874 - protein, 101 aa, Homo sapiens
QICKEFQDLLSQDRSPLGSSRPTPILDLDIQRHLTHFSLITHGFGTPAICAALSTFQTVLSEMLNYLEKHTTHKNGGAADSGQGHANSEKAPLRKTSEAAV

SEQ ID NO: 841875 - protein, 98 aa, Homo sapiens
MGTRAARKQDSGFPSALGAPGTNPTEHVPQETMQGQNQPPASPLTGLSRPRLSSHSLSASQEPGPGLGPAVQRPWVTPHQRDPSTAQKREAMPLSGKP

SEQ ID NO: 841876 - protein, 66 aa, Homo sapiens
MAIYIELKLDQSKNSACEARSHTSVLRSHAWRTALVLESADVEHSLHRESSLDGAGLQRPLPRECT

SEQ ID NO: 841877 - protein, 74 aa, Homo sapiens
LLAYGVAILYFFIFLINWFHLSLWTRSEFFLARDPRTPSGGLDRDPCLVTTADISLQHIELCVDVLELASCELT

SEQ ID NO: 841878 - protein, 40 aa, Homo sapiens
MEWKRLRASPGLVNYQISVKCSNQFLILQFLILGAIPQLG

SEQ ID NO: 841879 - protein, 132 aa, Homo sapiens
MEWKRLRASPGLVNYQISVKCSNQFKLEVCLLNAENKVVDNQAGTQGQLKVLGANLWWPYLMHEHPAYLYSWEVWLTAQKSLGPLTSTHSLWGSALWPSPRASSSSAGNLSISTASTSMRMRTCVGAPGSSW

SEQ ID NO: 841880 - protein, 183 aa, Homo sapiens
MEWKPCRASPGLVNYQISVKCSNQFKLEVCLLNAENKVVDNQAGTQGQLKVLGANLWWPYLMHEHPAYLYIVGGVADCTEVTGAFDFYTLPVGLRTVAVTESQFLISGKPFYFHGVNKHEDADIQGKGFDCPLLVKDFNLLCWLGANTFCPSHYPYTEEMLQICYRYGIVVIDECPAVGLMLP

SEQ ID NO: 841881 - protein, 590 aa, Homo sapiens
MDSVVFEDVAVDFTLEEWALLDSAQRDLYRDVMLETFQNLASVDDETQFKASGSVSQQDIYGEKIPKESKIATFTRNVSWASVLGKIWDSLSIEDQTTNQGRNLSRNHGLERLCESNDQCGEALSQIPHLNLYKKIPPGVKQYEYNTYGKVFMHRRTSLKSPITVHTGHKPYQCQECGQAYSCRSHLRMHVRTHNGERPYVCKLCGKTFPRTSSLNRHVRIHTAEKTYECKQCGKAFIDFSSLTSHLRSHTGEKPYKCKECGKAFSYSSTFRRHTITHTGEKPYKCKECAEAFSYSSTFRRHMISHTGEKPHKCKECGEAFSYSSAFRRHMITHTGEKPYECKQCGKTFIYLQSFRRHERIHTGEKPYECKQCGKTFIYPQSFRRHERTHGGEKPYECNQCGKAFSHPSSFRGHMRVHTGEKPYECKQCGKTFNWPISLRKHMRTHTREKPYECKQCGKAFSLSACFREHVRMHPEDKSYECKLCGKAFYCHISLQKHMRRHTAEKLYKCKQCGKAFSWPELLQQHVRTHTVEKPYECKECGKVFKWPSSLPIHMRLHTGEKPYQCKHCGKAFNCSSSLRRHVRIHTTEK

SEQ ID NO: 841882 - protein, 491 aa, Homo sapiens
MLLIFSRNHGLERLCESNDQCGEALSQIPHLNLYKKIPPGVKQYEYNTYGKVFMHRRTSLKSPITVHTGHKPYQCQECGQAYSCRSHLRMHVRTHNGERPYVCKLCGKTFPRTSSLNRHVRIHTAEKTYECKQCGKAFIDFSSLTSHLRSHTGEKPYKCKECGKAFSYSSTFRRHTITHTGEKPYKCKECAEAFSYSSTFRRHMISHTGEKPHKCKECGEAFSYSSAFRRHMITHTGEKPYECKQCGKTFIYLQSFRRHERIHTGEKPYECKQCGKTFIYPQSFRRHERTHGGEKPYECNQCGKAFSHPSSFRGHMRVHTGEKPYECKQCGKTFNWPISLRKHMRTHTREKPYECKQCGKAFSLSACFREHVRMHPEDKSYECKLCGKAFYCHISLQKHMRRHTAEKLYKCKQCGKAFSWPELLQQHVRTHTVEKPYECKECGKVFKWPSSLPIHMRLHTGEKPYQCKHCGKAFNCSSSLRRHVRIHTTEK

SEQ ID NO: 841883 - protein, 107 aa, Homo sapiens
RNSSSVPSLGDSRVTPRVHAANSPLSNVTPVKSLPGIWGCIPGSLCSELSEASDCCNKSNGRDLLQHHPSSFCFPMRAEIQCVCRGLRVRVSREFPIWRKGRKGERD

SEQ ID NO: 841884 - protein, 78 aa, Homo sapiens
LRQSRSKMAAVGVFSVSRLLGRSRPQLGRPMSSGAHGEEGSARMWKTLTFFVALPISASGPSRFPGEMVTILYSITLM

SEQ ID NO: 841885 - protein, 116 aa, Homo sapiens
SVPRHQKHHLPRPPRAPRLCAGSNSDTARLGSSNSDHGPRIMASPELMPPHRGARGHAPCSLEAGSPQPLDRLTPLPTSLTDGQVRWFTPVILALWEAVECGSPDVRSLRPAWPTR

SEQ ID NO: 841886 - protein, 119 aa, Homo sapiens
CGPRPLSEPELSPTLQKPLGSLILSPLASGGRRSGCHTGSLVLHGTHPTCHVVSFTVMPRASPSALELSQGRDGIFLVSAAPTSPSSQHRVWPVFLNEKARCHITVGNAIQAQSQKVPT

SEQ ID NO: 841887 - protein, 124 aa, Homo sapiens
ISLGDSPRRARGHAVKNSSHVDRRSMPSMGYMTHTVSAPSLHGKSADDTYLQLKKDLEYLDLKMTGRDLLKDRSLKPVKIAESDTDVKLSIFCEQDRVLQDLEDKIRALKENKDQLESVLEVLH

SEQ ID NO: 841888 - protein, 117 aa, Homo sapiens [sequence omitted]

SEQ ID NO: 841889 - protein, 140 aa, Homo sapiens
VARGYLEDPRAAQMMPTSRNMHIPGLIWPRGLPEHRDDLPISQEHKPQPGVQSSHKMLLLKKEADLEATASLLSPWGENSLVGSLYSILAQGNHMILHLHAPILRWLSLRFSPDILQLTTFLSVISLGDMVISREHHVGV

SEQ ID NO: 841890 - protein, 143 aa, Homo sapiens
NLTYRVLEKHRVVLHSRMPTSRNMHIPGLIWPRGLPEHRDDLPISQEHKPQPGVQSSHKMLLLKKEADLEATASLLSPWGENSLVGSLYSILAQGNHMILHLHAPILRWLSLRFSPDILQLTTFLSVISLGDMVISREHHVGV

SEQ ID NO: 841891 - protein, 68 aa, Homo sapiens
SEHLCSAASLGYCNSLLFPRSFIPQTFTECQLCVGTMLGARVRVMNKKVLGALPSLVPSNRFSQAEQE

SEQ ID NO: 841892 - protein, 85 aa, Homo sapiens
FRALLPKSALQVEEESWNAYPYTRTRYTCPFVEKFSIEIETYYLPDGGQQPNVFNLSSEPGSELRGEGTILMDNFFRNKLLSIHL

SEQ ID NO: 841893 - protein, 1354 aa, Homo sapiens
MSLPRGISQDRSPLVKVRSNSLKAPSTHVTKPSFSQKSFVSMKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGTKAEFHPCL

SEQ ID NO: 841894 - protein, 1307 aa, Homo sapiens
MSLPRGISQDRSPLVKVRSNSLKAPSTHVTKPSFSQKSFVSMKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKTSLTVRPRGKMCFDSPRPTVNACFRLKTEMIMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGTKAEFHPCL

SEQ ID NO: 841895 - protein, 764 aa, Homo sapiens
MQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGTKAEFHPCL

SEQ ID NO: 841896 - protein, 565 aa, Homo sapiens
MGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGTKAEFHPCL

SEQ ID NO: 841897 - protein, 1354 aa, Homo sapiens; identical to SEQ ID NO: 841893

SEQ ID NO: 841898 - protein, 252 aa, Homo sapiens
GSPLICWDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGTKAEFHPCL

SEQ ID NO: 841899 - protein, 1341 aa, Homo sapiens
MSLPRGISQDRSPLVKVRSNSLKAPSTHVTKPSFSQKSFVSMKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGTKAEFHPCL

SEQ ID NO: 841900 - protein, 620 aa, Homo sapiens
AIVIADSRGYNSARRKATVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGTKAEFHPCL

SEQ ID NO: 841901 - protein, 407 aa, Homo sapiens
MVWELYLNKTVKEIQQGIETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGTKAEFHPCL

SEQ ID NO: 841902 - protein, 973 aa, Homo sapiens
MSLPRGISQDRSPLVKVRSNSLKAPSTHVTKPSFSQKSFVSMKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTRLLKPPLPPLAPPLCWDSTEEVTAQ

SEQ ID NO: 841903 - protein, 67 aa, Homo sapiens
VCVCVCVCVCVRCGCGATSTKISKNVADSLGAQEESCCRCGTTAVSTRGMLSGIVGIGLSLQPQNNR

SEQ ID NO: 841904 - protein, 241 aa, Homo sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 841905 - protein, 348 aa, Homo sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQHSSFGEFLSKRSHKNGSIGKQTGSRKGSFRKRQQEKTVNFIKDTCNILCQNDNFVMLASRKFKFRKMHYDRFVIFLMPHIGCIVMALSKYLMMFQIYCKVCIPALKKNISMLNTIFTY

SEQ ID NO: 841906 - protein, 358 aa, Homo sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQVPLGSFYILAFAPGLHNPHPSSPRSGGGFSAIDNPRGSFRKRQQEKTVNFIKDTCNILCQNDNFVMLASRKFKFRKMHYDRFVIFLMPHIGCIVMALSKYLMMFQIYCKVCIPALKKNISMLNTIFTY

SEQ ID NO: 841907 - protein, 241 aa, Homo sapiens; identical to SEQ ID NO: 841904

SEQ ID NO: 841908 - protein, 241 aa, Homo sapiens; identical to SEQ ID NO: 841904

SEQ ID NO: 841909 - protein, 171 aa, Homo sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRFLLAKVHCRKL

SEQ ID NO: 841910 - protein, 283 aa, Homo sapiens
RAGKPGVGGGRRWASVAAKLAEKAVASEPPRQFPRLPGVKKKMTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 841911 - protein, 337 aa, Homo sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQKQREILPHRRGESTVTTEAEIGVMEPQQRNADSHQKLEEAKNRFFPRASSSRSMALQIPIKLILDFLASRTMGINLLFQAIKFVIICYCCHSKLIQEHAGQICNGLN

SEQ ID NO: 841912 - protein, 281 aa, Homo sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQVPLGSFYILAFAPGLHNPHPSSPRSGGGFSAIDNPRGALPPCLVCVLFHHL

SEQ ID NO: 841913 - protein, 241 aa, Homo sapiens; identical to SEQ ID NO: 841904

SEQ ID NO: 841914 - protein, 115 aa, Homo sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWL

SEQ ID NO: 841915 - protein, 241 aa, Homo sapiens; identical to SEQ ID NO: 841904

SEQ ID NO: 841916 - protein, 284 aa, Homo sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQVPLGSFYILAFAPGLHNPHPSSPRSGGGFSAIDNPRGALPPCLDRLERGNKKRL

SEQ ID NO: 841917 - protein, 147 aa, Homo sapiens
MKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 841918 - protein, 218 aa, Homo sapiens
MTLQWAAVATFLYAEIGLILIFCLPFIPPQRWQKIFSFNVWDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 841919 - protein, 241 aa, Homo sapiens; identical to SEQ ID NO: 841904

SEQ ID NO: 841920 - protein, 147 aa, Homo sapiens; identical to SEQ ID NO: 841917

SEQ ID NO: 841921 - protein, 190 aa, Homo sapiens
MKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQVPLGSFYILAFAPGLHNPHPSSPRSGGGFSAIDNPRGALPPCLDRLERGNKKRL

SEQ ID NO: 841922 - protein, 244 aa, Homo sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQVFAKLLNYLLMRKW

SEQ ID NO: 841923 - protein, 331 aa, Homo sapiens
MTSPHFSSYDEGPLDVSMAATNLENQLHSAQKNLLFLQREHASTLKGLHSEIRRLQQHCTDLTYELTVKSSEQTGDGTSKSSELKKRCEELEAQLKVKENENAELLKELEQKNAMITVLENTIKEREKKYLEELKAKSHKLTLLSSELEQRASTIAYLTSQLHAAKKKLMSSSGTSDASPSGSPVLASYKPAPPKDKLPETPRRRMKKSLSAPLHPEFEEVYRFGAESRKLLLREPVDAMPDPTPFLLARESAEVHLIKERPLVIPPIASDRSGEQHSPAREKPHKAHVGVAHRIHHATPPQAQPEVKTLAVDQVNGGKVVRKHSGTDRTV

SEQ ID NO: 841924 - protein, 331 aa, Homo sapiens; identical to SEQ ID NO: 841923

SEQ ID NO: 841925 - protein, 331 aa, Homo sapiens; identical to SEQ ID NO: 841923

SEQ ID NO: 841926 - protein, 314 aa, Homo sapiens
MAATNLENQLHSAQKNLLFLQREHASTLKGLHSEIRRLQQHCTDLTYELTVKSSEQTGDGTSKSSELKKRCEELEAQLKVKENENAELLKELEQKNAMITVLENTIKEREKKYLEELKAKSHKLTLLSSELEQRASTIAYLTSQLHAAKKKLMSSSGTSDASPSGSPVLASYKPAPPKDKLPETPRRRMKKSLSAPLHPEFEEVYRFGAESRKLLLREPVDAMPDPTPFLLARESAEVHLIKERPLVIPPIASDRSGEQHSPAREKPHKAHVGVAHRIHHATPPQAQPEVKTLAVDQVNGGKVVRKHSGTDRTV

SEQ ID NO: 841927 - protein, 228 aa, Homo sapiens
PRVTSSSRYFFSRSLMVFSIKEREKKYLEELKAKSHKLTLLSSELEQRASTIAYLTSQLHAAKKKLMSSSGTSDASPSGSPVLASYKPAPPKDKLPETPRRRMKKSLSAPLHPEFEEVYRFGAESRKLLLREPVDAMPDPTPFLLARESAEVHLIKERPLVIPPIASDRSGEQHSPAREKPHKAHVGVAHRIHHATPPQAQPEVKTLAVDQVNGGKVVRKHSGTDRTV

SEQ ID NO: 841928 - protein, 331 aa, Homo sapiens; identical to SEQ ID NO: 841923

SEQ ID NO: 841929 - protein, 331 aa, Homo sapiens; identical to SEQ ID NO: 841923

SEQ ID NO: 841930 - protein, 331 aa, Homo sapiens; identical to SEQ ID NO: 841923

SEQ ID NO: 841931 - protein, 331 aa, Homo sapiens; identical to SEQ ID NO: 841923

SEQ ID NO: 841932 - protein, 314 aa, Homo sapiens; identical to SEQ ID NO: 841926

SEQ ID NO: 841933 - protein, 331 aa, Homo sapiens; identical to SEQ ID NO: 841923

SEQ ID NO: 841934 - protein, 119 aa, Homo sapiens
MLLLLGPLRLPLCPPKRKNPLHLHLVTDAVARNILETLFHTWMVPAVRVSFYHADQLKAGAQPFPPPLSCVHRSPLSKTWWGWRRESSVPPPPTEAQTPLFWGFTPSPLCHCKHVFWCS

SEQ ID NO: 841935 - protein, 721 aa, Homo sapiens
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 841936 - protein, 744 aa, Homo sapiens
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQAEEALPGGVWQAGGWDVMGVSAQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 841937 - protein, 693 aa, Homo sapiens
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRAALKYLPALQQPQSPARG

SEQ ID NO: 841938 - protein, 535 aa, Homo sapiens
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVATWRLSTWRLSTLASVHVASVHVDRLVH

SEQ ID NO: 841939 - protein, 498 aa, Homo sapiens
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRTWPTMWCTVRGPYTPSTSFATWPWPRPSRLTSSSVTLTSCLPILSTTTSGGPAGRE

SEQ ID NO: 841940 - protein, 101 aa, Homo sapiens
ASSPEPRSCGSFRQLPYALPSQTRRRSVLWRTRVTGTWATSGRTTGPGLPWAGDLTQVGTVVRGGRRGGLLVLGPLGLGGAKNARKSPRKNIAVKRTLDEE

SEQ ID NO: 841941 - protein, 721 aa, Homo sapiens; identical to SEQ ID NO: 841935

SEQ ID NO: 841942 - protein, 686 aa, Homo sapiens
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 841943 - protein, 719 aa, Homo sapiens
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSGERPGSLPGLPRIPASSPEPRSCGSFRQLPYALPSQTRRRSVLWRTRVTGTWATSGRTTGPGLPWAGDLTQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 841944 - protein, 485 aa, Homo sapiens
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEANVVGIDRV

SEQ ID NO: 841945 - protein, 232 aa, Homo sapiens
FSPAHGCSSSGPPLSSWGWAAGARQHWWCRHSRPCATASASPIPRWSCWPCWMRALSTPSGRRGYFSAHSTHLPTLAPTTHELLASAWLPPTLLHRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 841946 - protein, 153 aa, Homo sapiens [sequence omitted]

SEQ ID NO: 841947 - protein, 153 aa, Homo sapiens [sequence omitted]

SEQ ID NO: 841948 - protein, 48 aa, Homo sapiens
GSSLAVAGADAGERPRSSLGSVLAPTLGFSLWAQAGVRLSFLYPSAEG

SEQ ID NO: 841949 - protein, 984 aa, Homo sapiens
MTVRRLSLLCRDLWALWLLLKAGADEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKEP

SEQ ID NO: 841950 - protein, 190 aa, Homo sapiens
AAISYRFTQYFLSGYYASYSVIIFYYELFISRSVWPIRPVGTIRGSTASPSSFYPFGLAPCLKAHHTGTSRCTCATGHRDVAGCSFGRWNAGALLPDAGMVHARSVGRWNAGALLPDAGMVHACPVGLWNAGALLPNAGMVHGCSVGRWNAGALLPDAGMVHACSVGRWNAGALLPKCRNGTRMLCWTLE

SEQ ID NO: 841951 - protein, 1417 aa, Homo sapiens
WGGGGGLATLPRLKLLGSNDPPASASASASASGVAGTTGLKYCFFKEGHVTYNTKPQKDSCGFGRGELREFLAYGPVMAAMALHRHELESAGGSQDAACVECTVWLGANHGEGGEPRACSARFPHWVLRPWAGDAPAGRGWSIPGQPRTHAWTQRPTDLLTWARRGWHAATRKGRAGLLRPLQLYTCHGAAGDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQEVARPRRRRPARCLGLRWRGEGAAPGRPEEGAPHRPDPERLAVRAAEDPSGAEAGSTEDPGPLGLPRRLQSPQRRGRREQPRAAGAGQRHLVLAPPCCFCLRTVLSGDARTVVELLPEKWRILWPTA

SEQ ID NO: 841952 - protein, 1249 aa, Homo sapiens
MTVRRLSLLCRDLWALWLLLKAGADEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQEVARPRRRRPARCLGLRWRGEGAAPGRPEEGAPHRPDPERLAVRAAEDPSGAEAGSTEDPGPLGLPRRLQSPQRRGRREQPRAAGAGQRHLVLAPPCCFCLRTVLSGDARTVVELLPEKWRILWPTA

SEQ ID NO: 841953 - protein, 1417 aa, Homo sapiens; identical to SEQ ID NO: 841951

SEQ ID NO: 841954 - protein, 1417 aa, Homo sapiens; identical to SEQ ID NO: 841951

SEQ ID NO: 841955 - protein, 1224 aa, Homo sapiens
WGGGGGLATLPRLKLLGSNDPPASASASASASGVAGTTGLKYCFFKEGHVTYNTKPQKDSCGFGRGELREFLAYGPVMAAMALHRHELESAGGSQDAACVECTVWLGANHGEGGEPRACSARFPHWVLRPWAGDAPAGRGWSIPGQPRTHAWTQRPTDLLTWARRGWHAATRKGRAGLLRPLQLYTCHGAAGDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPTQPPVEPTRGCTFLRGDSPHPPTLYVIECCH

SEQ ID NO: 841956 - protein, 444 aa, Homo sapiens
WGGGGGLATLPRLKLLGSNDPPASASASASASGVAGTTGLKYCFFKEGHVTYNTKPQKDSCGFGRGELREFLAYGPVMAAMALHRHELESAGGSQDAACVECTVWLGANHGEGGEPRACSARFPHWVLRPWAGDAPAGRGWSIPGQPRTHAWTQRPTDLLTWARRGWHAATRKGRAGLLRPLQLYTCHGAAGDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKRKEFEGLALEKKGAQVVLGSLKGWFA

SEQ ID NO: 841957 - protein, 139 aa, Homo sapiens
MTVRRLSLLCRDLWALWLLLKAGADEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIALRARCTESEPLHPGGSGI

SEQ ID NO: 841958 - protein, 1478 aa, Homo sapiens
WGGGGGLATLPRLKLLGSNDPPASASASASASGVAGTTGLKYCFFKEGHVTYNTKPQKDSCGFGRGELREFLAYGPVMAAMALHRHELESAGGSQDAACVECTVWLGANHGEGGEPRACSARFPHWVLRPWAGDAPAGRGWSIPGQPRTHAWTQRPTDLLTWARRGWHAATRKGRAGLLRPLQLYTCHGAAGDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYDPALSPGLPRTWLPLTLAPCRYVRDPTTGKEGWVPASSLSVRLGPSGSAQCLSSSVRPTCPEPTRDAAKGPGEEAAPCVPGRADAEARPRLISPQSRARGRRAEQLVQLQRGRPGPLLRPAGVARPRRRRPARCLGLRWRGEGAAPGRPEEGAPHRPDPERLAVRAAEDPSGAEAGSTEDPGPLGLPRRLQSPQRRGRREQPRAAGAGQRHLVLAPPCCFCLRTVLSGDARTVVELLPEKWRILWPTA

SEQ ID NO: 841959 - protein, 122 aa, Homo sapiens
MTVRRLSLLCRDLWALWLLLKAGAGAWGAGGSSPPRKVLWGDSAGTPGGGGRSGPSPVLRGCWGRSPGLGDAGDGCWGGCLRDQRSPVPWQGRCARALPDGWFRAMALGSLVSSGAASALGL

SEQ ID NO: 841960 - protein, 1223 aa, Homo sapiens
MRAGSGTAGMGLPGPPCAMPLTWYCRNGIMNMGDRSPKRFSEGFRGQPASHLHTLTAALFLTAACLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQEVARPRRRRPARCLGLRWRGEGAAPGRPEEGAPHRPDPERLAVRAAEDPSGAEAGSTEDPGPLGLPRRLQSPQRRGRREQPRAAGAGQRHLVLAPPCCFCLRTVLSGDARTVVELLPEKWRILWPTA

SEQ ID NO: 841961 - protein, 1287 aa, Homo sapiens
TTGGSLMFDCWRFILCKRPGSNSYSSPQRPNEAKKEETDHQIDVSDVIRLVQDTPEATAMATDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQEVARPRRRRPARCLGLRWRGEGAAPGRPEEGAPHRPDPERLAVRAAEDPSGAEAGSTEDPGPLGLPRRLQSPQRRGRREQPRAAGAGQRHLVLAPPCCFCLRTVLSGDARTVVELLPEKWRILWPTA

SEQ ID NO: 841962 - protein, 1241 aa, Homo sapiens
WSLPRRRRGTAGRSRPDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQEVARPRRRRPARCLGLRWRGEGAAPGRPEEGAPHRPDPERLAVRAAEDPSGAEAGSTEDPGPLGLPRRLQSPQRRGRREQPRAAGAGQRHLVLAPPCCFCLRTVLSGDARTVVELLPEKWRILWPTA

SEQ ID NO: 841963 - protein, 285 aa, Homo sapiens
MQTAAHHRGVPHGCLSLLGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQEVARPRRRRPARCLGLRWRGEGAAPGRPEEGAPHRPDPERLAVRAAEDPSGAEAGSTEDPGPLGLPRRLQSPQRRGRREQPRAAGAGQRHLVLAPPCCFCLRTVLSGDARTVVELLPEKWRILWPTA

SEQ ID NO: 841964 - protein, 509 aa, Homo sapiens
WGGGGGLATLPRLKLLGSNDPPASASASASASGVAGTTGLKYCFFKEGHVTYNTKPQKDSCGFGRGELREFLAYGPVMAAMALHRHELESAGGSQDAACVECTVWLGANHGEGGEPRACSARFPHWVLRPWAGDAPAGRGWSIPGQPRTHAWTQRPTDLLTWARRGWHAATRKGRAGLLRPLQLYTCHGAAGDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVSGPGWSRQPP

SEQ ID NO: 841965 - protein, 333 aa, Homo sapiens
WGGGGGLATLPRLKLLGSNDPPASASASASASGVAGTTGLKYCFFKEGHVTYNTKPQKDSCGFGRGELREFLAYGPVMAAMALHRHELESAGGSQDAACVECTVWLGANHGEGGEPRACSARFPHWVLRPWAGDAPAGRGWSIPGQPRTHAWTQRPTDLLTWARRGWHAATRKGRAGLLRPLQLYTCHGAAGDEIMHQDIVPLCAADIQDQLKKRFAYLSGGRGQDGSPVITFPDYPAFSEIPDKEFQNVMTYLTSIPSILFMESAASEHWGHVAEALPFLPPGSAHTAVTTSPEVLSPHLPKTCSPGPFLLLLLNSTATDHLWPFKCKMKAK

SEQ ID NO: 841966 - protein, 1708 aa, Homo sapiens
WEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCKKNNKAELNCLGMEPVQTANSRNGKKGHHTETVFNRVLPGPIAPESSKKRARRMRPDLSKMMALMQGGSTGSLSLHNTFQHSSSGLQSVSSLGHSSATSASLPFMPFVMGGAPSSPHVDSSTMLHHHHHHPHPHHHHHHHPGLRAPGYPSSPVTTASGTTLRLPPLQPEEDDDEDEEDDDDLSQGYDSSERDFSLIDDPMMPANSDSSEDADD

SEQ ID NO: 841967 - protein, 1087 aa, Homo sapiens
MQLGDRRRRRCKAAFKLKEIARREKQQRWTRREQTDFYRVVSTFGVEYDPDTMQFHWDRFRTFARLDKKTDESLTKYFHGFVAMAAKYAAFPQQQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCKKNNKAELNCLGMEPVQTANSRNGKKGHHTETVFNRVLPGPIAPESSKKRARRMRPDLSKMMALMQGGSTGSLSLHNTFQHSSSGLQSVSSLGHSSATSASLPFMPFVMGGAPSSPHVDSSTMLHHHHHHPHPHHHHHHHPGLRAPGYPSSPVTTASGTTLRLPPLQPEEDDDEDEEDDDDLSQGYDSSERDFSLIDDPMMPANSDSSEDADD

SEQ ID NO: 841968 - protein, 1650 aa, Homo sapiens
WEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCKKNNKAELNCLGMEPVQTANSRNGKKGHHTETVFNRVLPGPIAPESSKKRARRMRPDLSKMMALMQGGSTGSLSLHNTFQHSSSGLQSVSSLGHSSATSASLPFMPFVMGGAPSSPHVDSSTMLHHHHHHPHPHHHHHHHPGLQEVKRKKKKKCT

SEQ ID NO: 841969 - protein, 1519 aa, Homo sapiens
WEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELENMVTLQSPHHEVVVQLPWQRRKHLQSAQRQPSSPNFAEAWMKRSLQFKSKMRKD

SEQ ID NO: 841970 - protein, 160 aa, Homo sapiens [sequence omitted]

SEQ ID NO: 841971 - protein, 1369 aa, Homo sapiens
WEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGHPLFHKKKGNRKKLVELEVECMEEPNHLDVDLETRIPVINKVDGTLLVGEDAPRRAELENMVTLQSPHHEVVVQLPWQRRKHLQSAQRQPSSPNFAEAWMKRSLQFKSKMRKD

SEQ ID NO: 841972 - protein, 1025 aa, Homo sapiens
WEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRRETNLIAIEGVSNVGRGTMTHETQGQDHKEIRYTHYRNDKDNRRKMKRPDQVNRKGIRGAMEPDTVRRHNPSKMEMNTAEAKLVTGDNTLKKKRHKDS

SEQ ID NO: 841973 - protein, 88 aa, Homo sapiens
TLKLEHEVVARSRPTPQDYEMRVSPSDTTPLVSRSVPPVKLEDEDDSDSELDLSKLSPSSSSSSSSSSSSSSTDESEDEKEEKLSECM

SEQ ID NO: 841974 - protein, 1077 aa, Homo sapiens
MGEAGVNRPRQTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCKKNNKAELNCLGMEPVQTANSRNGKKGHHTETVFNRVLPGPIAPESSKKRARRMRPDLSKMMALMQGGSTGSLSLHNTFQHSSSGLQSVSSLGHSSATSASLPFMPFVMGGAPSSPHVDSSTMLHHHHHHPHPHHHHHHHPGLRAPGYPSSPVTTASGTTLRLPPLQPEEDDDEDEEDDDDLSQGYDSSERDFSLIDDPMMPANSDSSEDADD

SEQ ID NO: 841975 - protein, 1540 aa, Homo sapiens
WEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAVSGSPIQQDLKSFLWYLSCMRKRKHDILCHRFCICKIRVIINNTQSSNLTIVVMPKIK

SEQ ID NO: 841976 - protein, 1513 aa, Homo sapiens
WEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCTLEMGGSSHCGVQPGFCQ

SEQ ID NO: 841977 - protein, 161 aa, Homo sapiens [sequence omitted]

SEQ ID NO: 841978 - protein, 258 aa, Homo sapiens
WEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGEGMLGIYLNFCSTCVYFPDDSPWGQWMH

SEQ ID NO: 841979 - protein, 629 aa, Homo sapiens
RPRRGGAGTGPRGESAGLLLLLLQVLPPGATAGPGRRGTRGAGAGGGGVCWPGAAPAFPRDARLLLLLPPLPPLSPPPPSSAPAASASRMDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAKERLRPRAAPPKLPTPGLPQSPRRGASRPVF

SEQ ID NO: 841980 - protein, 165 aa, Homo sapiens
MREAESNKLVLICRLLCDPLSLARPSSPENGTDVAGHNQRTLVVGLDTSLTQEGWAPPAKHRPQCYAPPGYNMAEGCAAELLTSSVIQTSENKITEGGASQNNTQEQTTKNTQKKTNSNTTQEQQNTEKPDDKKTTRERRQRTKHKAEKPQATDHQRHEHRSAQT

SEQ ID NO: 841981 - protein, 621 aa, Homo sapiens
RPRRGGAGTGPRGESAGLLLLLLQDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 841982 - protein, 568 aa, Homo sapiens
RPRRGGAGTGPRGESAGLLLLLLQDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAEEGVPGLLYLGSSPSGCLMDSGPTHSQ

SEQ ID NO: 841983 - protein, 322 aa, Homo sapiens
LTGLAGIAEKDNTHQQKQRSVRTWRMHTGGCWGRGGAWCWVGTGVCLPHQPPDLCPGTLRNPLPQAEPALERATYRQTESADFIPFLPAGGGPVWEEGLSPAWAAQSKAEGVLFPGAVVSLGLGLGDARSVCAATCTSEEPPSPPACAPPSPQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAAPTSFETCTLMLAASCLPVGALGMEEAEEGVPGLLYLGSSPSGCLMDSGPTHSQ

SEQ ID NO: 841984 - protein, 598 aa, Homo sapiens
RPRRGGAGTGPRGESAGLLLLLLQDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 841985 - protein, 617 aa, Homo sapiens
LTGLAGIAEKDNTHQQKQRSVRTWRMHTGGCWGRGGAWCWVGTGVCLPHQPPDLCPGTLRNPLPQAEPALERATYRQTESADFIPFLPAGGGPVWEEGLSPAWAAQSKAEGVLFPGAVVSLGLGLGDARSVCAATCTSEEPPSPPACAPPSPQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 841986 - protein, 43 aa, Homo sapiens
MRFGGDQHPNHNKTEVIERGLQKYHPTLLLPPIGQNLVTWPQL

SEQ ID NO: 841987 - protein, 102 aa, Homo sapiens
APISLVHPAQIPSVPFCFLCLHSQTSMNDLALLSTKCDLVSGKQNRQFDDSVFRSKSPGNFGVIGEGQKKVPRLLWFSFAKGVTTGTGPVVSGSPWEGEVGF

SEQ ID NO: 841988 - protein, 155 aa, Homo sapiens
MLKAKILFVGPCESGKTVLANFLTESSDITEYSPTQGVRFESCWPALMKDAHGVVIVFNADIPSHRKEMEMWYSCFVQQPSLQDTQCMLIAHHKPGSGDDKGSLSLSPPLNKLKLVHSNLEDDPEEIRMEFIKYLKSIINSMSESRDREEMSIMT

SEQ ID NO: 841989 - protein, 108 aa, Homo sapiens
MKDAHGVVIVFNADIPSHRKEMEMWYSCFVQQPSLQDTQCMLIAHHKPGSGDDKGSLSLSPPLNKLKLVHSNLEDDPEEIRMEFIKYLKSIINSMSESRDREEMSIMT

SEQ ID NO: 841990 - protein, 79 aa, Homo sapiens
GRYYYYYYKFAAASTHHKPGSGDDKGSLSLSPPLNKLKLVHSNLEDDPEEIRMEFIKYLKSIINSMSESRDREEMSIMT

SEQ ID NO: 841991 - protein, 148 aa, Homo sapiens
MLKAKILFVGPCESGKTVLANFLTESSDITEYSPTQGVRILEFENPHVTSNNKGTGCEFELWDCGGDAKFESCWPALMKDAHGVVIVFNADIPSHRKEMEMWYSCFVQQPSLQDTQCMLIAHHKPGSGDDKGSLSLCKETGISLPLLS

SEQ ID NO: 841992 - protein, 185 aa, Homo sapiens
MLKAKILFVGPCESGKTVLANFLTESSDITEYSPTQGVRILEFENPHVTSNNKGTGCEFELWDCGGDAKFESCWPALMKDAHGVVIVFNADIPSHRKEMEMWYSCFVQQPSLQDTQCMLIAHHKPGSGDDKGSLSLSPPLNKLKLVHSNLEDDPEEIRMEFIKYLKSIINSMSESRDREEMSIMT

SEQ ID NO: 841993 - protein, 108 aa, Homo sapiens; identical to SEQ ID NO: 841989

SEQ ID NO: 841994 - protein, 108 aa, Homo sapiens; identical to SEQ ID NO: 841989

SEQ ID NO: 841995 - protein, 108 aa, Homo sapiens; identical to SEQ ID NO: 841989

SEQ ID NO: 841996 - protein, 116 aa, Homo sapiens
MIKEACLCVRKLEFLFLFCLECFGHLHIVPCPRNQQLCPVTEHLLYPRQLLPSPCESTTSLLKIQKLARHDGRRLYSQLLRGLRQENCLSPGGGDCSELRSHHYTPVCVTGRDTIS

SEQ ID NO: 841997 - protein, 317 aa, Homo sapiens
VNTAMHEAKLMEECDELVEIIQQRKQMIAVKIKETKVMKLRKLAQQVANCRQCLERSTVLINQAEHILKENDQARFLQSAKNIAERVAMATASSQVLIPDINFNDAFENFALDFSREKKLLEGLDYLTAPNPPSIREELCTASHDTITVHWISDDEFSISSYELQYTIFTGQANFISLYNSVDSWMIVPNIKQNHYTVHGLQSGTRYIFIVKAINQAGSEQCTYPTKKQTATFNWIPNDSQKVEDLHDGSRWRKMKVSKKSQPEKLVARAMGAGNSDELALGGRAHMVMVRNIQEWKPGPKTRHRGGPTARKVTRGD

SEQ ID NO: 841998 - protein, 219 aa, Homo sapiens
VIRLGFLSMDSTIPVLGTELTPINGREETPCYKQTLSFTGLTCIVSLVALTGNAVVLWLLGCRMRRNAVSIYILNLVAADFLFLSGHIICSPLRLINIRHPISKILSPVMTFPYFIGLSMLSAISTERCLSILWPIWYHCRRPRYLSSVMCVLLWALSLLRSILEWMFCDFLFSGANSVWCETSDFITIAWLVFLCVVLCGSSLVLLVRILCGSRKMPL

SEQ ID NO: 841999 - protein, 136 aa, Homo sapiens
FSLLLLFSDSMPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 842000 - protein, 72 aa, Homo sapiens
SVKSTGFGIRQNWIIILAPWHTSHVTWFKLLTFSEPQFPYHKNWIVTPINTWAFREDDICKPGTAGYSVSDT

SEQ ID NO: 842001 - protein, 100 aa, Homo sapiens
WSSEKLWPKMEEQVCGRRGPRTRSPDASVENTFYFTTWSPSYPRAYEQPGNYFGGYQQGDLEILEIGKNKTICLGRQRELVSSRTLIPALGHWYSWFSGL

SEQ ID NO: 842002 - protein, 366 aa, Homo sapiens
SKLEKGHLRGPEIRDWRGPQLEGEKDWGLEGYVWRGSQLEDQALRGLEGYTWRVAQLEDRRSTTDLRGTQFDYERVRSLEGSPWRGAQLHDERAGGLRTAEWKGPQSEVEKGRGLEVRNLRGIPLEKSLELAPENGDQRGPQWEDERRRGPEIAEERGARVGVKRRRGLEDIVLVQLGDTRVTGMENGDGGGARSVGPKSRAGRGMEWGDAGGRCLGLGNGVVSGTPVGTVLEGSPEWAAARSEHLAAGDGLQEGGEDGPREPKRLCRPPGEEEVDWEPLAKFRAACGPELADLVAEELAFARQHGTRGFHWTGAGFALKDGTSDFFLDGALTRCSCSIHAARRLPCRHLFAARLLTGAALFHMDL

SEQ ID NO: 842003 - protein, 229 aa, Homo sapiens
EKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFASPS

SEQ ID NO: 842004 - protein, 62 aa, Homo sapiens
RLGRGLDRVRLQSVRALQEGSLHWNRTGYWLWSLLGDCCVEKEGRVQPSDWDSPDPGHKSLE

SEQ ID NO: 842005 - protein, 66 aa, Homo sapiens
RYPLWTLPPAIESVLLLEGEEIPIHKDTKVPNASLFTINKEGHTLGYIINQVHCFPFAFCRDCQFH

SEQ ID NO: 842006 - protein, 84 aa, Homo sapiens
GRLVPSLPSLSSVCCSVGHLPGGPAARHQSDRSYDSLIGDSGWVWILTPGLCLLSQTLICHPHAEPSCHPQKPIRLPPAHGMDF

SEQ ID NO: 842007 - protein, 538 aa, Homo sapiens
MPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLLVIVFIPAFWSLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 842008 - protein, 538 aa, Homo sapiens; identical to SEQ ID NO: 842007

SEQ ID NO: 842009 - protein, 84 aa, Homo sapiens
MVRGQPSSLCMWRRGGWGGQWRLSLEGWERKNIPGGGALGSGNLGLAAGMTSLLSEGRRPGAGHSKPGGCCEEDICDSLGGEWG

SEQ ID NO: 842010 - protein, 538 aa, Homo sapiens; identical to SEQ ID NO: 842007

SEQ ID NO: 842011 - protein, 538 aa, Homo sapiens; identical to SEQ ID NO: 842007

SEQ ID NO: 842012 - protein, 258 aa, Homo sapiens [sequence omitted]

SEQ ID NO: 842013 - protein, 365 aa, Homo sapiens
MPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLLVIVFIPAFWSLKTHPLWRLWKKIWAVPSPERFFMPLYKGCSGDFKVSSRPCDELLGAPPPLQEPHLPSPQAPQPHPTGLEHPGLSQATSQASVSPCAKCRQSFLWCRIGRRIKQDLTRCGG

SEQ ID NO: 842014 - protein, 330 aa, Homo sapiens
MNASGSGYPLASLYVGDLHPDVTEAMLYEKFSPAGPILSIRVCRDVATRRSLGYAYINFQQPADAERALDTMNFEMLKGQPIRIMWSQRDPGLRKSGVGNIFIKNLEDSIDNKALYDTFSTFGNILSCKVACDEHGSRGFGFVHFETHEAAQQAINTMNGMLLNDRKVFVGHFKSRREREAELGARALEFTNIYVKNLPVDVDEQGLQDLFSQFGKMLSVKVMRDNSGHSRCFGFVNFEKHEEAQKAVVHMNGKEVSGRLLYAGRAQKRVERQNELKRRFEQMKQDRLRRYQGVNLYVKNLDDSIDDDKLRKEFSPYGVITSAKKRRQRP

SEQ ID NO: 842015 - protein, 259 aa, Homo sapiens [sequence omitted]

SEQ ID NO: 842016 - protein, 296 aa, Homo sapiens
MNASGSGYPLASLYVGDLHPDVTEAMLYEKFSPAGPILSIRVCRDVATRRSLGYAYINFQQPADAERALDTMNFEMLKGQPIRIMWSQRDPGLRKSGVGNIFIKNLEDSIDNKALYDTFSTFGNILSCKVACDEHGSRGFGFVHFETHEAAQQAINTMNGMLLNDRKVFVGHFKSRREREAELGARALEFTNIYVKNLPVDVDEQGLQDLFSQFGKMLSVKVSGRLLYAGRAQKRVERQNELKRRFEQMKQDRLRRYQGVNLYVKNLDDSIDDDKLRKEFSPYGVITSAKKRRQRP

SEQ ID NO: 842017 - protein, 114 aa, Homo sapiens [sequence omitted]

SEQ ID NO: 842018 - protein, 186 aa, Homo sapiens
MVTVRTRIAVLSLRPPVWWNSRKVFVGHFKSRREREAELGARALEFTNIYVKNLPVDVDEQGLQDLFSQFGKMLSVKVMRDNSGHSRCFGFVNFEKHEEAQKAVVHMNGKEVSGRLLYAGRAQKRVERQNELKRRFEQMKQDRLRRYQGVNLYVKNLDDSIDDDKLRKEFSPYGVITSAKKRRQRP

SEQ ID NO: 842019 - protein, 83 aa, Homo sapiens
RSLHGCVLHLSWYIPRSGIAVSLPAPALPSTINKSSLRPPRKWKDDGAMLVFPAEPMMKKYLLWNYFVQKKKVENCQRNQNKD

SEQ ID NO: 842020 - protein, 54 aa, Homo sapiens
HPTCLGSGVNTGLVMGKLFSPGNQDEQLKSSRKRSENRKQLLSEASSWPRSQGG

SEQ ID NO: 842021 - protein, 107 aa, Homo sapiens
AVSIGWEGGVYVQTCGHTLHIDCHKSYMESLRNDQVLQGFSVDKGEFTCPLCRQFANSVLPCYPGSNVENNPWQRPSNKSIQDLIKEVEELQGRPGAFPVSISVRHK

SEQ ID NO: 842022 - protein, 42 aa, Homo sapiens
RERPLPESATYAGVFSGKERLCKAQRAEQRDGSKSAQAWQIP

SEQ ID NO: 842023 - protein, 60 aa, Homo sapiens
TFLLLPCFCCFCFCPRGSVPLLTPYREGLVTRLFSVLPSSLTLSRACLLLPASALAGAGG

SEQ ID NO: 842024 - protein, 108 aa, Homo sapiens
SKQNIFKHKLHRTYKTKIQVKKQKQKTKNQSTQTTKNMMNVTIPHISILTLNVKGLNAPLKRYRTAEWVRTHQPIICCLQKTHLAHKDSNKLKVKGWKKAFHANGHQK

SEQ ID NO: 842025 - protein, 178 aa, Homo sapiens
NRRVGKQELSIGANCDRIATVQHEFLHALGFWHEQSRSDRDDYVRIMWDRILSGREHNFNTYSDDISDSLNVPYDYTSVMHYSKTAFQNGTEPTIVTRISDFEDVIGQRMDFSDSDLLKLNQLYNCSSSLSFMDSCSFELENVCGMIQSSGDNADWQRVSQVPRGPESDHSNMGQCQG

SEQ ID NO: 842026 - protein, 61 aa, Homo sapiens
LLGVDKASWVCGFIAFVTFGNLWPLFSQIPRLPSGLQLLARGIPCCRPQVTEVVFVSCRLL

SEQ ID NO: 842027 - protein, 105 aa, Homo sapiens
IHPSKVKHNSVYQDISMVPRYTYLQVSFLGGVCYNQLEISSFKNLLSNLGFPIHILEMTLTNLLPRLECSGTIMAHCSLNFLASNNPPTSASRIVGLRAQANTPG

SEQ ID NO: 842028 - protein, 102 aa, Homo sapiens
MFLITPQLSTKWLLTFQHRMLASVCQTCNVLLPCSSLLLAQEKWPLSALKFLSPLSMAYLGHTSQAAFVFHWFCHFPLEDCKLPKGRGRAPGISQGSLAPFS

SEQ ID NO: 842029 - protein, 122 aa, Homo sapiens
MNHCIQFSPQSLQRWLILPCYDLKLPIWANTTEFCPHGPRRASQDPQLLAWLPDQSLEVSLELYDWNSMTFTLFLETVEPVAVESEGSGIFSFVWQQLIFPAEARWCFSWAQDCGLDGSFPG

SEQ ID NO: 842030 - protein, 345 aa, Homo sapiens
PSRRPGVNGTRHFQSPPPVPGEVLKLDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 842031 - protein, 476 aa, Homo sapiens
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 842032 - protein, 476 aa, Homo sapiens; identical to SEQ ID NO: 842031

SEQ ID NO: 842033 - protein, 217 aa, Homo sapiens [sequence omitted]

SEQ ID NO: 842034 - protein, 140 aa, Homo sapiens
TGGDSQINGLVRGLVCEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 842035 - protein, 476 aa, Homo sapiens; identical to SEQ ID NO: 842031

SEQ ID NO: 842036 - protein, 512 aa, Homo sapiens
LGLGCGPGLRPLEELSIPGASFQGLPSRREPAPAATMASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 842037 - protein, 477 aa, Homo sapiens
LGLGCGPGLRPLEELSIPGASFQGAALSKGASAGSHHGVTHRVAHAAHAGAGAAGGAAGAHAATGCHALHAAAAAAATAAARRAAHPGHQYPRPLPVATTCAWGGVEGAVLPGESHILPSAAVAASEGAGVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 842038 - protein, 102 aa, Homo sapiens
PLIRAVWCAIHKLITGSKTERPMSALLSNFHTEALSRDVVSFVTSALASRSQSKLVRELHYFFFPLPVTSLKDSKLSARKTSLSSSENCQFNEGKAEECIGG

SEQ ID NO: 842039 - protein, 77 aa, Homo sapiens
ENMLLLQRLQFQMAKCMEAEMDLLEFSINHCSSVRGPIMMIPTQPGPPTAYIQSSEEAEWHCLYSPQMLQNQQEGRL

SEQ ID NO: 842040 - protein, 320 aa, Homo sapiens
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 842041 - protein, 176 aa, Homo sapiens
QLLTRCHFHLAVQLLWEVDTGKEDHHGGDGCMCVEEVLVVELKILPAFCVQHSCYMYYNYLICVKIQGSAFCYFHQAELEMLRNMARSWGSKSDAKASNPRNKTADHQLPTQAQPPFRAPRLPTQGPSPLVFPVNALLAIQPSGSIRVSCFYMIIFPPGKTALSVKVPPTRRLINA

SEQ ID NO: 842042 - protein, 69 aa, Homo sapiens
LCERRNQSYSPHPYWGPRFEDAPLLKTQKRHPSRTLPLRQPRNLDLRAPSSSEDPGTQNAQIFELMNEN

SEQ ID NO: 842043 - protein, 129 aa, Homo sapiens
MLCEEAAQKRKGKEPGMALPQGRLTFRDVAIEFSLAEWKCLNPSQRALYREVMLENYRNLEAVDISSKRMMKEVLSTGQGNTEVIHTGTLQRYQSYHIGDFCFQEIEKEIHDIEFQCQEDERNGHEAPM

SEQ ID NO: 842044 - protein, 418 aa, Homo sapiens
AALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPASVSTVSYGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGIL

SEQ ID NO: 842045 - protein, 410 aa, Homo sapiens
AALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGIL

SEQ ID NO: 842046 - protein, 35 aa, Homo sapiens
MLGIQERQMSPCFTELTVLWGRQKLKLLHACTQTH

SEQ ID NO: 842047 - protein, 936 aa, Homo sapiens
MLRPEISSTSPSAPAVSPSSGETRSPQGPRYNFGLQETPQSRPSVQVVSASTCPGTSGAAGDRSSSSSSLPCPAPNSRPAQGSYFGNKRAYAENTVASNFTFGASSSSARDTNYPQTLKTPLSTGNPQRSGYKSWTPQVGYSASSSSAISAHSPSVIVAVVEGRGLARGEIGMASIDLKNPQIILSQFADNTTYAKVITKLKILSPLEIIMSNTACAVGNSTKLFTLITENFKNVNFTTIQRKYFNETKGLEYIEQLCIAEFSTVLMEVQSKYYCLAAVAALLKYVEFIQNSVYAPKSLKICFQGSEQTAMIDSSSAQNLELLINNQDYRNNHTLFGVLNYTKTPGGSRRLRSNILEPLVDIETINMRLDCVQELLQDEELFFGLQSVISRFLDTEQLLSVLVQIPKQDTVNAAESKITNLIYLKHTLELVDPLKIAMKNCNTPLLRAYYGSLEDKRFGIILEKIKTVINDDARYMKGCLNMRTQKCYAVRSNINEFLDIARRTYTEIVDDIAGMISQLGEKYSLPLRTSFSSARGFFIQMTTDCIALPSDQLPSEFIKISKVKNSYSFTSADLIKMNERCQESLREIYHMTYMIVCKLLSEIYEHIHCLYKLSDTVSMLDMLLSFAHACTLSDYVRPEFTDTLAIKQGWHPILEKISAEKPIANNTYVTEGSNFLIITGPNMSGKSTYLKQIALCQIMAQIGSYVPAEYSSFRIAKQIFTRISTDDDIETNSSTFMKEMKEIAYILHNANDKSLILIDELGRGTNTEEGIGICYAVCEYLLSLKAFTLFATHFLELCHIDALYPNVENMHFEVQHVKNTSRNKEAILYTYKLSKGLTEEKNYGLKAAEVSSLPPSIVLDAKEITTQITRQILQNQRSTPEMERQRAVYHLATRLVQTARNSQLDPDSLRIYLSNLKKKYKEDFPRTEQVPEKTEE

SEQ ID NO: 842048 - protein, 936 aa, Homo sapiens; identical to SEQ ID NO: 842047

SEQ ID NO: 842049 - protein, 105 aa, Homo sapiens
MLIAPRVVLRTSGGGPWGSLEALPPPLSPAPECGCAPEVCPHPLPTFSPVSSPDPTASAPASKWQLTDFLISSSVVTPKLWQPVAASPWTCSSSGFPTCCPCPNF

SEQ ID NO: 842050 - protein, 75 aa, Homo sapiens
APPLSAAPALSLLGPFFLCKGAYKANGICKSRCSQGLFDGGLCIQTVPPWYLVHWKALGVQGACMGKMLRPLSSL

SEQ ID NO: 842051 - protein, 231 aa, Homo sapiens
VLPVGLKQCLLDRISHHANKSHLSQRQSQSAAWSKEELKAYWQRKSPGIPAGANRKKKINGSSPDTFTSGGYHSPGDVSLGGPGSWGQGAQGAERVRTSKEEKKHEIHLVQKLGRSLFKLKNQTAEPLAPQPPAGPSKVEQLQDETNHLRKELESVGRQLQAEVENNQMLSLLNRRQEERLREQEERLREQEERLCEQEERLCEQEERLREQEERLCEQEKLPGQERLLEE

SEQ ID NO: 842052 - protein, 243 aa, Homo sapiens
SFDLTTQSPKFSHPISGSSGCSTNFQLEGEWRLWDLGATELKAYWQRKSPGIPAGANRKKKINGSSPDTFTSGGYHSPGDSQYQELAVALDSSSAIISQLTENINSLVRTSKEEKKHEIHLVQKLGRSLFKLKNQTAEPLAPQPPAGPSKVEQLQDETNHLRKELESVGRQLQAEVENNQMLSLLNRRQEERLREQEERLREQEERLCEQEERLCEQEERLREQEERLCEQEKLPGQERLLEE

SEQ ID NO: 842053 - protein, 258 aa, Homo sapiens
VLPVGLKQCLLDRISHHANKSHLSQRQSQSAAWSKEELKAYWQRKSPGIPAGANRKKKINGSSPDTFTSGGYHSPGDQQGIYGEGRASSTTLQDLESQYQELAVALDSSSAIISQLTENINSLVRTSKEEKKHEIHLVQKLGRSLFKLKNQTAEPLAPQPPAGPSKVEQLQDETNHLRKELESVGRQLQAEVENNQMLSLLNRRQEERLREQEERLREQEERLCEQEERLCEQEERLREQEERLCEQEKLPGQERLLE

SEQ ID NO: 842054 - protein, 111 aa, Homo sapiens
MSTNLTSFFLLLPSLDIACTLGNGAVHSSRSVSCPELYLRLRPLTQPQGMGWSFVQRQKKARQRYSIPGAARPQQSAQLLAEGLCDLPRDAELSQTRWPPTKGPRPGKLRP

SEQ ID NO: 842055 - protein, 305 aa, Homo sapiens
RKDRPLPPPSSLKASSRELTAGAPELDVLLMVHLQVCKALLQKLASPNLSRLVQECLLEEVAQQKHVLETLSVLDFEKVGKATSIEESPSGGKPFGVLVMCSPRVTIQVSELGLSVIPQASRTKGCLKLWRGCTGPGRVLSCPATTLLNQLKKTFQHRVRGKYPGQLEIACRRLLEQVVSCGGLLPGAGLPEEQIITWFQFHSYLQRQSVSDLEKHFTQLTKEVTLIEELHCAGLRPLTQPQGMGWSFVQRQKKARQRYSIPGAARPQQSAQLLAEGLCDLPRDAELSQTRWPPTKGPRPGKLRP

SEQ ID NO: 842056 - protein, 111 aa, Homo sapiens; identical to SEQ ID NO: 842054

SEQ ID NO: 842057 - protein, 305 aa, Homo sapiens; identical to SEQ ID NO: 842055

SEQ ID NO: 842058 - protein, 116 aa, Homo sapiens
SVCPSPLRRQVPIVSRPGESRGVRAVEPARSPETGPRSLCRMRRIETSRFRDVRGVRLRATLATPLSAPNGARCPPGGTREAAGAHFLSRGCEHVSTGEGRRGVRSAESRRPSHGG

SEQ ID NO: 842059 - protein, 121 aa, Homo sapiens [sequence omitted]

SEQ ID NO: 842060 - protein, 492 aa, Homo sapiens
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEEFDKFLEERAKAADRLPNLSSPSAEGPPGPPSGPAPRKKTQEKDDDMLFAL

SEQ ID NO: 842061 - protein, 492 aa, Homo sapiens
CVTRRVGGAGGCCQLIPGVGGSGGSSNGLSPGEPVQLSSGTAHRESHRWLPAERGLGPQHGDLRHHQRDGGRVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEEFDKFLEERAKAADRLPNLSSPSAEGPPGPPSGPAPRKKTQEKDDDMLFAL

SEQ ID NO: 842062 - protein, 492 aa, Homo sapiens; identical to SEQ ID NO: 842060

SEQ ID NO: 842063 - protein, 412 aa, Homo sapiens
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGASPLG

SEQ ID NO: 842064 - protein, 123 aa, Homo sapiens
LEDPPEYTATSEGYLTNSWKNGPKPRTDCPTSPAPQLRGPRVPHLAQRPGRRPRRKMMTCCLPYECGVWHPAAQVPTALTPLGWDLPPSSGVKAALGVACYPLFLLFEDGAAPAVAGGVEAVG

SEQ ID NO: 842065 - protein, 392 aa, Homo sapiens
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPWLWLATEGRVWRCGGPLRSCGGPGTKLQLCAQWARSHQPQAAGEASGDAGAPLPLRCLALHPSSVPSGRAPQHWGSPLG

SEQ ID NO: 842066 - protein, 189 aa, Homo sapiens
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQVSARTGQGTARKSCQCRSFLPSGESRPSCLSQAPLLISGRLGCRLVGCSVGREACQLRALLWSGQGR

SEQ ID NO: 842067 - protein, 492 aa, Homo sapiens; identical to SEQ ID NO: 842060

SEQ ID NO: 842068 - protein, 559 aa, Homo sapiens
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERDRGLTVLPRLVSNSWPQAVLPPWPPESIGITGMSHHTHLPTLYHSVQESHPQERLGLAELHCAYQLGFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEEFDKFLEERAKAADRLPNLSSPSAEGPPGPPSGPAPRKKTQEKDDDMLFAL

SEQ ID NO: 842069 - protein, 414 aa, Homo sapiens
EVPKGVTSEEFDKVPGTNGPKPRTELPNLSSPQLRGPRVPHLAQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEEFDKFLEERAKAADRLPNLSSPSAEGPPGPPSGPAPRKKTQEKDDDMLFAL

SEQ ID NO: 842070 - protein, 472 aa, Homo sapiens
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGRSQSPRPASWRTSSSGCPLTWVMMRKSLRGSPAKNLTNSWKNGRPRYEAATLRAVGEISSAPGCR

SEQ ID NO: 842071 - protein, 383 aa, Homo sapiens
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKE

SEQ ID NO: 842072 - protein, 325 aa, Homo sapiens
MDFLLGNPFSSPVGQRIEKATDGSLQSEDWALNMEICDIINETEEGPKDALRAVKSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPWLWLATEGRVWRCGGPLRSCGGPGTKLQLCAQWARSHQPQAAGEASGDAGAPLPLRCLALHPSSVPSGRAPQHWGSPLG

SEQ ID NO: 842073 - protein, 73 aa, Homo sapiens
MQNGKRPFGKVLPNPPAWEQTLTSLQNHWQGEPGPKDLWVTLKLSKPRPPRGQGGRLTELGAARHFGALANEC

SEQ ID NO: 842074 - protein, 180 aa, Homo sapiens
TLHRAYTGFAAVEIRSRAKIEKIRASLFNNNDLIGLSSLDGEDELMEMSTEEILTVSVVNQSLFDTQGSPGLEDYFNDKSIKGEKLVPGAREVLTEIFKSCAHSEQTLSLTPAKPIRVSDIYLSKEQINSQTPGNLLHLFFTNVRPPKKVLEDQLTQILRKYGVPKPKFEPAVRREVPSS

SEQ ID NO: 842075 - protein, 934 aa, Homo sapiens
MRIPPKWNCSATDLFYQGNSQTVREWLNVAITRTLHQGEESLLELTKQICSFLQTAPEQFPSEEFPISESKVNMDVNFPGAAFVVVSCKESQSGFRKDSSLYKAPWARVLVYGLGHKVKRNGQLNLIEAACYPRDASPANTGLAPPPTADQYPSVVLSTDRVHIKLGVSPPPGAVLVLHSLPLEFPLAMAFAEQLLSWKSEDSEGKSEDEPDTIPTSVLLQVVELLGNFLWTTDMAACVKELVFHLLAELLRTVHTLEQRRHPAGLSSSIALQLNPCLAMLMALQSELHKLYDEETQNWVSGGACGGSGGAAAGDQGRFSTYFHALMEGCLAVAEVTLPTNMSVTASGVTSATAPNLSDSSSSSSSSPGQTPQSPSLLSKRKKVKMKREKASSSGKRQSSRTVDSDPTVLSIGGSKPEDMLWFHRALTLLIILRHLTRKDPQGLGVTSDAIADACQALVGPTAHSRLLVISGIPTHLDEGVVRGAIRKACNAHGGVFKDEIYIPLQEEDTKKPKDKAEGGDGKVEPEKTLAFPGTDSMEVSTSSSLTPAMSISASASTSQASICSSQGISQTVSDLSVDPLPAGLELPIPPGLLEPHAVSSQESLDISLCSTGSLGSLGSLGEPLDNAETASVSDMGSMYTVTSLDNQPLAARPIKGFAVVEIRSRAKIEKIRASLFNNNDLIGLSSLDGEDELMEMSTEEILTVSVVNQSLFDTQGSPGLEDYFNDKSIKGEKLVPGAREVLTEIFKSCAHSEQTLSLTPAKPIRVSDIYLSKEQINSQTPGNLLHLFFTNVRPPKKVLEDQLTQILRKYGVPKPKFDKSKYSKAGKEQHPVKVVSTKRPITKPPAKDKAVLNSVSRTALSEKKPTVKPKSPEKSKPDEKDPEKSPTKKQEVPEEKYLTLEGFHKFVIDRARQDIRSVWRAILSCGYDLHFER

SEQ ID NO: 842076 - protein, 829 aa, Homo sapiens
MRIPPKWNCSATDLFYQGNSQTVREWLNVAITRTLHQGEESLLELTKQICSFLQTAPEQFPSEEFPISESKVNMDVNFPGAAFVVVSCKESQSGFRKDSSLYKAPWARVLVYGLGHKVKRNGQLNLIEAACYPRDASPANTGLAPPPTADQYPSVVLSTDRVHIKLGVSPPPGAVLVLHSLPLEFPLAMAFAEQLLSWKSEDSEGKSEDEPDTIPTSVLLQVVELLGNFLWTTDMAACVKELVFHLLAELLRTVHTLEQRRHPAGLSSSIALQLNPCLAMLMALQSELHKLYDEETQNWVSGGACGGSGGAAAGDQGRFSTYFHALMEGCLAVAEVTLPTNMSVTASGVTSATAPNLSDSSSSSSSSPGQTPQSPSLLSKRKKVKMKREKASSSGKRQSSRTVDSDPTVLSIGGSKPEDMLWFHRALTLLIILRHLTRKDPQGLGVTSDAIADACQALVGPTAHSRLLVISGIPTHLDEGVVRGAIRKACNAHGGVFKDEIYIPLQEEDTKKPKDKAEGGDGKVEPEKTLAFPGTDSMEVSTSSSLTPAMSISASASTSQASICSSQGISQTVSDLSVDPLPAGLELPIPPGLLEPHAVSSQESLDISLCSTGSLGSLGSLGEPLDNAETASVSDMGSMYTVTSLDNQPLAARPIKGFAVVEIRSRAKIEKIRASLFNNNDLIGLSSLDGEDELMEMSTEEILTVSVVNQSLFDTQGSPGLEDYFNDKSIKGEKLVPGAREVLTEIFKSCAHSEQTLSLTPAKPIRVSDIYLSKEQINSQTPGNLLHLFFTNVRPPKKVLEDQLTQILRKYGVPKPKFEPAVRREVPSS

SEQ ID NO: 842077 - protein, 111 aa, Homo sapiens
TLPGECQAEVEADGLEMFTQEELCKFIKFACNQERIPFTCPCKDGGPDTAHVPPYPMKIAPPDGTAGSPDSRYIRVETCMFMIKLPQYSSLEIMLEKLRCAIHYREDPLSG

SEQ ID NO: 842078 - protein, 873 aa, Homo sapiens
MRIPPKWNCSATDLFYQGNSQTVREWLNVAITRTLHQGEESLLELTKQICSFLQTAPEQFPSEEFPISESKVNMDVNFPGAAFVVVSCKESQSGFRKDSSLYKAPWARVLVYGLGHKVKRNGQLNLIEAACYPRDASPANTGLAPPPTADQYPSVVLSTDRVHIKLGVSPPPGAVLVLHSLPLEFPLAMAFAEQLLSWKSEDSEGKSEDEPDTIPTSVLLQVVELLGNFLWTTDMAACVKELVFHLLAELLRTVHTLEQRRHPAGLSSSIALQLNPCLAMLMALQSELHKLYDEETQNWVSGGACGGSGGAAAGDQGRFSTYFHALMEGCLAVAEVTLPTNMSVTASGVTSATAPNLSDSSSSSSSSPGQTPQSPSLLSKRKKVKMKREKASSSGKRQSSRTVDSDPTVLSIGGSKPEDMLWFHRALTLLIILRHLTRKDPQGLGVTSDAIADACQALVGPTAHSRLLVISGIPTHLDEGVVRGAIRKACNAHGGVFKDEIYIPLQEEDTKKPKDKAEGGDGKVEPEKTLAFPGTDSMEVSTSSSLTPAMSISASASTSQASICSSQGISQTVSDLSVDPLPAGLELPIPPGLLEPHAVSSQESLDISLCSTGSLGSLGSLGEPLDNAETASVSDMGSMYTVTSLDNQPLAARPIKGFAVVEIRSRAKIEKIRASLFNNNDLIGLSSLDGEDELMEMSTEEILTVSVVNQSLFDTQGSPGLEDYFNDKSIKGEKLVPGAREVLTEIFKSCAHSEQTLSLTPAKPIRVSDIYLSKEQINSQTPGNLLHLFFTNVRPPKKVLEDQLTQILRKYGVPKPKFDKSKYSKAGKEQHPVKVVSTKRPITKPPAKDKAVLNSVRTALSEKKHLQNQIRAE

SEQ ID NO: 842079 - protein, 181 aa, Homo sapiens
MRIPPKWNCSATDLFYQGNSQTVREWLNVAITRTLHQGEESLLELTKQICSFLQTAPEQFPSEEFPISESKVNMDVNFPGAAFVVVSCKESQSGFRKDSSLYKAPWARVLVYGLGHKVKRNGQLNLIEAACYPRDASPANTGLAPPPTADQYPSVVLSTDRVHIKLGVSPPPGSSTIGGIL

SEQ ID NO: 842080 - protein, 151 aa, Homo sapiens
MDATALERDAVQFARLAVQRDHEGRYSEAVFYYKEAAQALIYAEMAGSSLENIQEKITEYLERVQALHSAVQSKSADPLKSKHQLDLERAHFLVTQAFDEDEKENVEDAIELYTEAVDLCLKTSYETADKVLQNKLKQLARQALDRARSAG

SEQ ID NO: 842081 - protein, 390 aa, Homo sapiens
RSPASLASAAPASKELVRARLRLRRAAGGRGEGRWGREVGRPGGLQAGSGLRGAASRWTPARQREGELSSTVQSKLCRSFRGAPESSPPPGRRSPRRAVLRQGLLPCPGAGPLRHGRHSTGAGRCAVRPSGGSARPRRPLLRGGVLLQVQSKSADPLKSKHQLDLERAHFLVTQAFDEDEKENVEDAIELYTEAVDLCLKTSYETADKVLQNKLKQLARQALDRAEALSEPLTKPVGKISSTSVKPKPPPVRAHFPLGANPFLERPQSFISPQSCDAQGQRYTAEEIEVLRTTSKINGIEYVPFMNVDLRERFAYPMPFCDRWGKLPLSPKQKTTFSKWVRPEDLTNNPTMIYTVSSFSIKQTIVSDCSFVASLAISAAYERRFNKKLIT

SEQ ID NO: 842082 - protein, 467 aa, Homo sapiens
RSPASLASAAPASKELVRARLRLRRAAGGRGEGRWGREVGRPGGLQAGSGLRGAASRWTPARQREGELSSTVQSKLCRSFRGAPESSPPPGRRSPRRAVLRQGLLPCPGAGPLRHGRHSTGAGRCAVRPSGGSARPRRPLLRGGVLLQGSVKQLLLKQLDSKSDVQEMASLETGMMTHEVYTLGLLQEKEAAQALIYAEMAGSSLENIQEKITEYLERVQALHSAVQSKSADPLKSKHQLDLERAHFLVTQAFDEDEKENVEDAIELYTEAVDLCLKTSYETADKVLQNKLKQLARQALDRAEALSEPLTKPVGKISSTSVKPKPPPVRAHFPLGANPFLERPQSFISPQSCDAQGQRYTAEEIEVLRTTSKINGIEYVPFMNVDLRERFAYPMPFCDRWGKLPLSPKQKTTFSKWVRPEDLTNNPTMIYTVSSFSIKQTIVSDCSFVASLAISAAYERRFNKKLIT

SEQ ID NO: 842083 - protein, 312 aa, Homo sapiens
MDATALERDAVQFARLAVQRDHEGRYSEAVFYYKEAAQALIYAEMAGSSLENIQEKITEYLERVQALHSAVQSKSADPLKSKHQLDLERAHFLVTQAFDEDEKENVEDAIELYTEAVDLCLKTSYETADKVLQNKLKQLARQALDRAEALSEPLTKPVGKISSTSVKPKPPPVRAHFPLGANPFLERPQSFISPQSCDAQGQRYTAEEIEVLRTTSKINGIEYVPFMNVDLRERFAYPMPFCDRWGKLPLSPKQKTTFSKWVRPEDLTNNPTMIYTVSSFSIKQTIVSDCSFVASLAISAAYERRFNKKLIT

SEQ ID NO: 842084 - protein, 39 aa, Homo sapiens
GGYLRPSQRGLLLELTFGNGWGIPAEDKCWRKHKAWGAS

SEQ ID NO: 842085 - protein, 169 aa, Homo sapiens
PGVDPSPPCRSLGWKRKKEWSDESEEEPEKELAPEPEETWVVEMLCGLKMKLKQQRVSPILPEHHKDFNSQLEDPVIKRFLAWDKDLRVSDKYLLAMVIAYFSRAGLPSWQYQRIHFFLALYLANDMEEDDEDPKQNIFYFLYGKTRSRIPLVRNRRFQLCRCLNPRAR

SEQ ID NO: 842086 - protein, 93 aa, Homo sapiens
PGVDPSPPCRSLGWKRKKEWSDESEEEPEKELAPEPEETWVVEMLCGLKMKLKQQRVSPILPEHHKDFNSQLGRRTPQRAPPILFFLKRGNFQ

SEQ ID NO: 842087 - protein, 281 aa, Homo sapiens
MEWLLEDLLGAKGDMGLLWGQLTHALACRHCGSSCFQSPGNLVTLFLFVVWQIQRWWQLGRLRQLHPWCSGNMVQGKELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPSPLKLSVCSSVFFNKLAFLPRSNLLLPQYHSSAQFSTHGAHTMEDLEGMAPILSCFHLHLLLLL

SEQ ID NO: 842088 - protein, 252 aa, Homo sapiens
MEWLLEDLLGAKGDMGLLWGQLTHALACRHCGSSCFQSPGNLELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPSPLKLSVCSSVFFNKLAFLPRSNLLLPQYHSSAQFSTHGAHTMEDLEGMAPILSCFHLHLLLLSHHYSSI

SEQ ID NO: 842089 - protein, 287 aa, Homo sapiens
MEWLLEDLLGAKGDMGLLWGQLTHALACRHCGSSCFQSPGNLVTLFLFVVWQIQRWWQLGRLRQLHPWCSGNMVQGKELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPSPLKLSVCSSVFFNKLAFLPRSNLLLPQYHSSAQFSTHGAHTMEDLEGMAPILSCFHLHLLLLSHHYSSI

SEQ ID NO: 842090 - protein, 58 aa, Homo sapiens
MPVEYNLPVEYNLPVEYNLPVEYNLPVEYNLPVEYNLPVGYNLPVEYNLPVEYNLPVE

SEQ ID NO: 842091 - protein, 202 aa, Homo sapiens
LGTLCPFVWCFPLSLEPDSIIEKASHSGMINPSRQWQTLKQNTGVAHFEYQIRVTCDDYYYGFGCNKFCRPRDDFFGHYACDQNGNKTCMEGWMGPECNRGMCVCVHVHVCLLLLVSIYHPTSRQVACGYLRWGGILAVILGLQYEDAECRRCCWCPIQIPFTGIPIPQVLCWLPTAHSCSLLRRLVLGQNSACPIPPAHSQ

SEQ ID NO: 842092 - protein, 994 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIGKWSKMNESPLSNFSVTQLLKNILKDLFKEKKVKIASKDRPYPNHSISLCNFQVSKVFWVMLIRIGGSGRRNDPSSEMSWNVVQRQLSEKDDFLSFLDTAGFYHTLAFGFGNMLALVAVVWDSVGGGCGEVTVCRHPSLTAILVFAAEHACLSDPCHNRGSCKETSLGFECECSPGWTGPTCSTNIDDCSPNNCSHGGTCQDLVNGFKCVCPPQWTGKTCQLDANECEAKTFYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 842093 - protein, 1234 aa, Homo sapiens
YRRPTLFVWIPSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIGKWSKMNESPLSNFSVTQLLKNILKDLFKEKKVKIASKDRPYPNHSISLCNFQVSKVFWVMLIRIGGSGRRNDPSSEMSWNVVQRQLSEKDDFLSFLDTAGFYHTLAFGFGNMLALVAVVWDSVGGGCGEVTVCRHPSLTAILVFAAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 842094 - protein, 917 aa, Homo sapiens
MLALVAVVWDSVGGGCGEVTVCRHPSLTAILVFAAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 842095 - protein, 591 aa, Homo sapiens
MDINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 842096 - protein, 443 aa, Homo sapiens
AGDSPGSLHIQRFHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 842097 - protein, 170 aa, Homo sapiens
MLFSFFLGELIGFVPAFTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 842098 - protein, 1364 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIGKWSKMNESPLSNFSVTQLLKNILKDLFKEKKVKIASKDRPYPNHSISLCNFQVSKVFWVMLIRIGGSGRRNDPSSEMSWNVVQRQLSEKDDFLSFLDTAGFYHTLAFGFGNMLALVAVVWDSVGGGCGEVTVCRHPSLTAILVFAAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 842099 - protein, 1364 aa, Homo sapiens; identical to SEQ ID NO: 842098

SEQ ID NO: 842100 - protein, 868 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIGKWSKMNESPLSNFSVTQLLKNILKDLFKEKKVKIASKDRPYPNHSISLCNFQVSKVFWVMLIRIGGSGRRNDPSSEMSWNVVQRQLSEKDDFLSFLDTAGFYHTLAFGFGNMLALVAVVWDSVGGGCGEVTVCRHPSLTAILVFAAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETSESATLWGALGCMGHVGGIPLQRGKTFFVLEISGSKTAVISALGQYHLCLICIYES

SEQ ID NO: 842101 - protein, 988 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIGKWSKMNESPLSNFSVTQLLKNILKDLFKEKKVKIASKDRPYPNHSISLCNFQVSKVFWVMLIRIGGSGRRNDPSSEMSWNVVQRQLSEKDDFLSFLDTAGFYHTLAFGFGNMLALVAVVWDSVGGGCGEVTVCRHPSLTAILVFAAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQSECPPPLNSPRAVGADPDTLGDLQWKPEAELFDVCFCITWVCINDLMGYSPDLGMRKSPIR

SEQ ID NO: 842102 - protein, 414 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTSKSNFQPVSILRILVPRYHAGERYLGLSSVNVSVREGRVQA

SEQ ID NO: 842103 - protein, 1218 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 842104 - protein, 1364 aa, Homo sapiens; identical to SEQ ID NO: 842098

SEQ ID NO: 842105 - protein, 1027 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIGKWSKMNESPLSNFSVTQLLKNILKDLFKEKKVKIASKDRPYPNHSISLCNFQVSKVFWVMLIRIGGSGRRNDPSSEMSWNVVQRQLSEKDDFLSFLDTAGFYHTLAFGFGNMLALVAVVWDSVGGGCGEVTVCRHPSLTAILVFAAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEGSRIRLPGACPAPWSLSSHFCQMS

SEQ ID NO: 842106 - protein, 917 aa, Homo sapiens; identical to SEQ ID NO: 842094

SEQ ID NO: 842107 - protein, 1218 aa, Homo sapiens; identical to SEQ ID NO: 842103

SEQ ID NO: 842108 - protein, 1268 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIGKWSKMNESPLSNFSVTQLLKNILKDLFKEKKVKIASKDRPYPNHSISLCNFQVSKVFWVMLIRIGGSGRRNDPSSEMSWNVVQRQLSEKDDFLSFLDTAGFYHTLAFGFGNMLALVAVVWDSVGGGCGEVTVCRHPSLTAILVFAAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKSAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKLSYDLT

SEQ ID NO: 842109 - protein, 106 aa, Homo sapiens
AGDSPGSLHIQRFHPCYNSGTCVDGDNWYRCECAPGFAGPDCRININECQSSPCAFGATCVDEINGYRCVCPPGHSGAKCQEGSRIRLPGACPAPWSLSSHFCQMS

SEQ ID NO: 842110 - protein, 354 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIGKWSKMNESPLSNFSVLSF

SEQ ID NO: 842111 - protein, 106 aa, Homo sapiens
GRRGSGDGSTGGSTSANSSGGVPSARGARRSDAFPTDARPVRAPPKPPARPALCPASQGRSPSPGLPPSRPLPPLAAPWAVEPREQARQPSSARLLAPAPERLHLG

SEQ ID NO: 842112 - protein, 109 aa, Homo sapiens
NTAEEEGEDEACASSCSSVHPGRASRAEGFLSNHPPRVESAPRNRPSRQSALPWALNAHSLGLGEATTKTAQSEASGCARTRACRTLAGNLISNEWLMALGKFSPVRQS

SEQ ID NO: 842113 - protein, 116 aa, Homo sapiens
SHATLLMTLATPLLKPPIPPCTTSFSAKDLASYSTEKNRVTRREHLQASSATSVYLLASAPVFVVFLSDMVDGLSSYLPGANSSGWALETQLSCHSCSRTFPAFLGLSVEQSSTTN

SEQ ID NO: 842114 - protein, 119 aa, Homo sapiens [sequence omitted]

SEQ ID NO: 842115 - protein, 143 aa, Homo sapiens
ATRVSLEAGPGCRLAMASEASVRLGVPPGRLWIQRPGIYEDEEGRTWVTVVVRFNPSRREWARASQGSRYEPSITVHLWQMAVHTRELLSSGQMPFSQLPAVWQLYPGRKYRAADSSFWEIADHGQIDSMEQLVLTYQPERKD

SEQ ID NO: 842116 - protein, 141 aa, Homo sapiens
MEPRVTQRKRPLDGCMGKITGITSDILKYDHKCFKLSLPAKFPEVCGSDEVFPDPDLLHVLPVAGSLQQSIDQCCLQLESLCRPGLLCAHPTLLFKLHSSMKNRPFFSLIYTYVKKTQQVRKRDRKPRGQVAAGPNPTSVM

SEQ ID NO: 842117 - protein, 105 aa, Homo sapiens [sequence omitted]

SEQ ID NO: 842118 - protein, 141 aa, Homo sapiens; identical to SEQ ID NO: 842116

SEQ ID NO: 842119 - protein, 141 aa, Homo sapiens; identical to SEQ ID NO: 842116

SEQ ID NO: 842120 - protein, 105 aa, Homo sapiens [sequence omitted]

SEQ ID NO: 842121 - protein, 141 aa, Homo sapiens; identical to SEQ ID NO: 842116

SEQ ID NO: 842122 - protein, 141 aa, Homo sapiens; identical to SEQ ID NO: 842116

SEQ ID NO: 842123 - protein, 141 aa, Homo sapiens; identical to SEQ ID NO: 842116

SEQ ID NO: 842124 - protein, 143 aa, Homo sapiens; identical to SEQ ID NO: 842115

SEQ ID NO: 842125 - protein, 141 aa, Homo sapiens; identical to SEQ ID NO: 842116

SEQ ID NO: 842126 - protein, 141 aa, Homo sapiens; identical to SEQ ID NO: 842116

SEQ ID NO: 842127 - protein, 105 aa, Homo sapiens [sequence omitted]

SEQ ID NO: 842128 - protein, 141 aa, Homo sapiens; identical to SEQ ID NO: 842116

SEQ ID NO: 842129 - protein, 141 aa, Homo sapiens; identical to SEQ ID NO: 842116

SEQ ID NO: 842130 - protein, 141 aa, Homo sapiens; identical to SEQ ID NO: 842116

SEQ ID NO: 842131 - protein, 163 aa, Homo sapiens [sequence omitted]

SEQ ID NO: 842132 - protein, 107 aa, Homo sapiens
STGRICSEKVLSKLLAVLLRIEVCCQVRTAKTSKQKEILRIEDSILESETHALGFKVKKKQNVKPHSDHHRSENRRIVITVSFTFMLWGGMNVMAVRQDREENTQNV

SEQ ID NO: 842133 - protein, 155 aa, Homo sapiens
TLGGLDTIVKIPPHVLREKCLLPLQLALESKNVKLAQHALAGMQKLLSEERFVSMETDSDEKQLLNQILNAVKVTPSLNEDLQVEVMKVLLCITYTPTFDLNGSAVLKIAEVCIETYISSCHQRSINTAVRATLSQMLSDLTLQLRQRQENTVSL

SEQ ID NO: 842134 - protein, 138 aa, Homo sapiens
PYYPRYLAQHALAGMQKLLSEERFVSMETDSDEKQLLNQILNAVKVTPSLNEDLQVEVMKVLLCITYTPTFDLNGSAVLKIAEVCIETYISSCHQRSINTAVRATLSQMLSDLTLQLRQRQENTIIENPDVPQDFGNQ

SEQ ID NO: 842135 - protein, 127 aa, Homo sapiens
PYYPRYLAQHALAGMQKLLSEERFVSMETDSDEKQLLNQILNAVKVTPSLNEDLQVEVMKVLLCITYTPTFDLNGSAVLKIAEVCIETYISSCHQRSINTAVRATLSQMLSDLTLQLRQRQENTVSL

SEQ ID NO: 842136 - protein, 465 aa, Homo sapiens
MASQLTQRGALFLLFFLTPAVTPTWYAGSGYYPDESYNEVYAEEVPQAPALDYRVPRWCYTLNIQDGEATCYSPKGGNYHSSLGTRCELSCDRGFRLIGRRSVQCLPSRRWSGTAYCRQMRCHALPFITSGTYTCTNGVLLDSRCDYSCSSGYHLEGDRSRICMEDGRWSGGEPVCVDIDPPKIRCPHSREKMAEPEKLTARVYWDPPLVKDSADGTITRVTLRGPEPGSHFPEGEHVIRYTAYDRAYNRASCKFIVKVQVRRCPTLKPPQHGYLTCTSAGDNYGATCEYHCDGGYDRQGTPSRVCQSSRQWSGSPPICAPMKINVNVNSAAGLLDQFYEKQRLLIISAPDPSNRYYKMQISMLQQSTCGLDLRHVTIIELVGQPPQEVGRIREQQLSANIIEELRQFQRLTRSYFNMVLIDKQGIDRDRYMEPVTPEEIFTFIDDYLLSNQELTQRREQRDICE

SEQ ID NO: 842137 - protein, 465 aa, Homo sapiens; identical to SEQ ID NO: 842136

SEQ ID NO: 842138 - protein, 473 aa, Homo sapiens
MASQLTQRGALFLLFFLTPAVTPTWYAGSGYYPDESYNEVYAEEVPQAPALDYRACLSSIATVPRWCYTLNIQDGEATCYSPKGGNYHSSLGTRCELSCDRGFRLIGRRSVQCLPSRRWSGTAYCRQMRCHALPFITSGTYTCTNGVLLDSRCDYSCSSGYHLEGDRSRICMEDGRWSGGEPVCVDIDPPKIRCPHSREKMAEPEKLTARVYWDPPLVKDSADGTITRVTLRGPEPGSHFPEGEHVIRYTAYDRAYNRASCKFIVKVQVRRCPTLKPPQHGYLTCTSAGDNYGATCEYHCDGGYDRQGTPSRVCQSSRQWSGSPPICAPMKINVNVNSAAGLLDQFYEKQRLLIISAPDPSNRYYKMQISMLQQSTCGLDLRHVTIIELVGQPPQEVGRIREQQLSANIIEELRQFQRLTRSYFNMVLIDKQGIDRDRYMEPVTPEEIFTFIDDYLLSNQELTQRREQRDICE

SEQ ID NO: 842139 - protein, 465 aa, Homo sapiens; identical to SEQ ID NO: 842136

SEQ ID NO: 842140 - protein, 132 aa, Homo sapiens
FCIWKYKCSSTVCLKAIFLPLNCFCTFVKNHFNTPVWVYFWALYFFPLTYLSFHQHHTVLITILLACLSSIATVPRWCYTLNIQDGEATCYSPKGGNYHSSLGTRCELSCDRGFRLIGRRSVQCLPSRRWSG

SEQ ID NO: 842141 - protein, 403 aa, Homo sapiens
MKLEVFVPRAAHGDKQGSDLEGAGGSDAPSPLSAAGDDSLGSDGDCAANSPAAGGGARDTQGDGEQSAGGGPGAEEAIPAAAAAAVVAEGAEAGAAGPGAGGAGSGEGARSKPYTRRPKPPYSYIALIAMAIRDSAGGRLTLAEINEYLMGKFPFFRGSYTGWRNSVRHNLSLNDCFVKVLRDPSRPWGKDNYWMLNPNSEYTFADGVFRRRRKRLSHRAPVPAPGLRPEEAPGLPAAPPPAPAAPASPRMRSPARQEERASPAGKFSSSFAIDSILRKPFRSRRLRDTAPGTTLQWGAAPCPPLPAFPALLPAAPCRALLPLCAYGAGEPARLGAREAEVPPTAPPLLLAPLPAAAPAKPLRGPAAGGAHLYCPLRLPAALQAASVRRPGPHLPYPVETLLA

SEQ ID NO: 842142 - protein, 403 aa, Homo sapiens; identical to SEQ ID NO: 842141

SEQ ID NO: 842143 - protein, 403 aa, Homo sapiens; identical to SEQ ID NO: 842141

SEQ ID NO: 842144 - protein, 403 aa, Homo sapiens; identical to SEQ ID NO: 842141

SEQ ID NO: 842145 - protein, 372 aa, Homo sapiens
MSKAFGLLRQICQSILAESSQSPADLEEKKEEDSNMKREQPRERPRAWDYPHGLVGLHNIGQTCCLNSLIQVFVMNVDFTRILKRITVPRGADEQRRSVPFQMLLLLEKMQDSRQKAVRPLELAYCLQKCNVPLFVQHDAAQLYLKLWNLIKDQITDVHLVERLQALYTIRVKDSLICVDCAMESSRNSSMLTLPLSLFDVDSKPLKTLEDALHCFFQPRELSSKSKCFCENCGKKTRGKQVLKLTHLPQTLTIHLMRFSIRNSQTRKICHSLYFPQSLDFSQILPMKRESCDAEEQSGGQYELFAVIAHVGMADSGHYCVYIRNAVDGKWFCFNDSNICLVSWEDIQCTYGNPNYHWQETAYLLVYMKMEC

SEQ ID NO: 842146 - protein, 372 aa, Homo sapiens; identical to SEQ ID NO: 842145

SEQ ID NO: 842147 - protein, 212 aa, Homo sapiens
MNKFPRRIPQKSCPRILCWSCQEVSPEVADAICQAIVLSAPGPHAVLLVTQLGRFTDEDQQVVRRLQEVFGVGVLGHTILVFTRKEDLAGGSLEDYVRETNNQALAWLDVTLARRHCGFNNRAQGEEQEAQLRELMEKVEAIMWENEGDYYSNKAYQYTQQNFRLKELQERQVSQGQGSEDVPGEESWLEGLSQIQKESEEAHRCLLGKADL

SEQ ID NO: 842148 - protein, 292 aa, Homo sapiens
MEEEEYEQIPQENPPEELSQDPVLELSGGLREKEQKTPRRLRLILMGKTGSGKSATGNSILGRDVFESKLSTRPVTKTSQRRSREWAGKELEVIDTPNILSPQVSPEVADAICQAIVLSAPGPHAVLLVTQLGRFTDEDQQVVRRLQEVFGVGVLGHTILVFTRKEDLAGGSLEDYVRETNNQALAWLDVTLARRHCGFNNRAQGEEQEAQLRELMEKVEAIMWENEGDYYSNKAYQYTQQNFRLKELQERQVSQGQGSEDVPGEESWLEGLSQIQKESEEAHRCLLGKADL

SEQ ID NO: 842149 - protein, 292 aa, Homo sapiens; identical to SEQ ID NO: 842148

SEQ ID NO: 842150 - protein, 292 aa, Homo sapiens; identical to SEQ ID NO: 842148

SEQ ID NO: 842151 - protein, 89 aa, Homo sapiens
LLSRLILIDEYIRGTGGDENYNNGNQVDSWIPPISIVVQGSLHSGHDPAFLMILLWQQKASSFFICLSSFFPYSHISPLDNTTQYQYFN

SEQ ID NO: 842152 - protein, 321 aa, Homo sapiens
PEFQSRCEQGHTASEGSRGGSFLPLWLLVAPGAPWLVVVPLPSLPPHRPCASVSALFFFFLRQSPALLPRLEYSGAISAHCNLCLLGLSDPPASASLVAGTTGVHHHTWLIFVFLVETGFHQVVQASLKLLTSGDPPTSASQSARITGVSHCLRPVSTLLVGTPVIGFRAHPPLRWPHLRSLNSICKGSIPNKILSTGSAWTWALGGDPVLPTLPLSLESHLWPCFWCPCVDPRCFSPGLLGPSHLGHTGPCPTSQGEGLQVSDQTVTSLGFLPPPQVPPSLPIFTQADRARGKPGTCPASSLSGSGRSRAIDGDVLRPLL

SEQ ID NO: 842153 - protein, 35 aa, Homo sapiens
IRGDEEVGGDGAQKGHIQSLEAESREFGMTESLCC

SEQ ID NO: 842154 - protein, 142 aa, Homo sapiens
HTYRHRDTPDTHTITHRHTPYIQRYTRHTHNHTDTPHTYRHRNTPQTHNQTHPIHTDTEIDHTHTITQTHPIYTDTPQTHNHRHTQTQRYTTDTQSHRHTPYIQTQIHHRHTQSYRHTPYIHRDTPQTHTQSHTDTPHTDTD

SEQ ID NO: 842155 - protein, 310 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEELVQRNRLICRRNPYRIFEYLQLSLEEVCFQHII

SEQ ID NO: 842156 - protein, 402 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKVTQHQLCHWSVT

SEQ ID NO: 842157 - protein, 465 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 842158 - protein, 406 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 842159 - protein, 484 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRGHSKYMCCRIEHCSVFLTRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 842160 - protein, 465 aa, Homo sapiens; identical to SEQ ID NO: 842157

SEQ ID NO: 842161 - protein, 465 aa, Homo sapiens; identical to SEQ ID NO: 842157

SEQ ID NO: 842162 - protein, 465 aa, Homo sapiens; identical to SEQ ID NO: 842157

SEQ ID NO: 842163 - protein, 406 aa, Homo sapiens; identical to SEQ ID NO: 842158

SEQ ID NO: 842164 - protein, 428 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKVTQHQLCHWSVT

SEQ ID NO: 842165 - protein, 428 aa, Homo sapiens; identical to SEQ ID NO: 842164

SEQ ID NO: 842166 - protein, 115 aa, Homo sapiens [sequence omitted]

SEQ ID NO: 842167 - protein, 136 aa, Homo sapiens
AASDSLSAKISFLHLKVIYHTATMLQVKIYDPTNKRYEVPVPLNTPPQPVGDPENRLYDVRIQNNPFGIQIQRKNSSTVIWDSQLPGFIFNDMFLSISTRLPSQYIYGFGETEHTTFRRNMNWNTWGMFAHDEPPA

SEQ ID NO: 842168 - protein, 171 aa, Homo sapiens
MTINNRYWMQLSTSHGILVLSEVKRTYEILSTKRRYLKYFFSKSHTHTHTLSLSLSLSLSLSLSPSLCLSLSLSLDTPSDPLSRALYTIYKRKNFFFHIHFLERHAVTPYTRLTHTLSLRGTPFPPDMGCLILTLFSPSMCVRVWGHVLPSKQSVCFLLTYRGWECRVHIS

SEQ ID NO: 842169 - protein, 101 aa, Homo sapiens
ASARQGGLRRAVLGVRFGEGALAWEERVCEGCAGAGETRSRVVSAQCVVWGGRPRPGFPCSFSSGRASWFPFQASPILGRCFIQRLGHLCRWRCFPLNYKL

SEQ ID NO: 842170 - protein, 111 aa, Homo sapiens
FPLCGSSKFPPTSGLGFQALSDKVDATLLLDCNAHCVEMFVFQCRQGVVTSGRTTGTMFVSLSSGQLGVSSLYITSCPGALRRQSIMSFGIPDGNFETLVHSKDWSCVILK

SEQ ID NO: 842171 - protein, 105 aa, Homo sapiens
FGGMLTATKEVGSPGKKTTNQPQRFLTLIWRTSRASGETFLIGAMTKLGTFEKHSFGVAWIPRYTTGVVVLDMPCIKCIVFWRLHRCNDKIGYSAIFAIHCTAYI

SEQ ID NO: 842172 - protein, 256 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQCVRMWPGTVAHSCNPSTLGGRGRWIS

SEQ ID NO: 842173 - protein, 756 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 842174 - protein, 756 aa, Homo sapiens; identical to SEQ ID NO: 842173

SEQ ID NO: 842175 - protein, 697 aa, Homo sapiens
MSSDGTIRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 842176 - protein, 167 aa, Homo sapiens [sequence omitted]

SEQ ID NO: 842177 - protein, 149 aa, Homo sapiens [sequence omitted]

SEQ ID NO: 842178 - protein, 140 aa, Homo sapiens
MVVPAALMAQGSLVSRWSSRFLSSCDFHPGPRTQPSVGTAGALSAHWRSSITEAQRTSLAPQTFRGTAMAAPSSAVRKVLGVRFATHVTGQCPIQIFQGRVRAALGDSLSSPALQRPCSLSSLTLQLVFLLDSASPKQTV

SEQ ID NO: 842179 - protein, 82 aa, Homo sapiens
PGTGRSVGIAMAAPSSAVRKVLGVRFATHVTGQCPIQIFQGRVRAALGDSLSSPALQRPCSLSSLTLQLVFLLDSASPKQTV

SEQ ID NO: 842180 - protein, 769 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTVTACVRLLRFHVLSFYGKIEEKMEMQSGIILNLN

SEQ ID NO: 842181 - protein, 593 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRACVLGRGVPVSHSI

SEQ ID NO: 842182 - protein, 753 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTPCAGDPTRV

SEQ ID NO: 842183 - protein, 705 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKR

SEQ ID NO: 842184 - protein, 473 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKVSPGFVHTILFTLAVPPGKLNTLSDFNSALSCSLLITQCGYPGWFLSWSMVSSVWPDRKHKSPCWTCYFQTLQDRSLAFIAKNDAITLESLKLPAWPS

SEQ ID NO: 842185 - protein, 102 aa, Homo sapiens
SHLGFGEVPLQAAGGSESLANLSTEKGRSARLELSRRCAAQNRVGQELGQGLAGREPGSAGAIPCHTFGPGQKHRRPMPGLSPGMVSREGAAGGPGTGGLGA

SEQ ID NO: 842186 - protein, 38 aa, Homo sapiens
MFILCSKTVVCKQKALELLPKVEEVVSLMNEDEKTVVR

SEQ ID NO: 842187 - protein, 219 aa, Homo sapiens
MALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 842188 - protein, 775 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIGKSQSRNSGRVLQGECGASSSALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 842189 - protein, 477 aa, Homo sapiens
MLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 842190 - protein, 140 aa, Homo sapiens; identical to SEQ ID NO: 842178

SEQ ID NO: 842191 - protein, 109 aa, Homo sapiens
MSWSPSLTTQTCGAWEMKERLGTGGFGNVIRWHNQDAALRGHCRRLVCTLEVLHYRGPAHIAGPTNVQGYSHGSSFLCREKSAWSTVCHTRDWTVSNSNLSGQSPSSAW

SEQ ID NO: 842192 - protein, 752 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVRGNQGPGSFNGPLKMGDLVYQNRKE

SEQ ID NO: 842193 - protein, 673 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACVSECCGPGPLA

SEQ ID NO: 842194 - protein, 563 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDL

SEQ ID NO: 842195 - protein, 48 aa, Homo sapiens
MSPDLPALEEGLGDAGMRSPSSLLSDSLDLMKRVSAAADWMHSCHRFC

SEQ ID NO: 842196 - protein, 136 aa, Homo sapiens
VVIQVISSGHSLFDILFIYFFLRWSLTLSPRRECSGAISAHCNLCLLGSSNSPASASQVAGNTGVSHCARPTCANFLNLRDHLVYLLKNTAPWRGRIRICRGGPWESVIFKQVSQVVLMLRQVWEMCEPTLIQSSL

SEQ ID NO: 842197 - protein, 173 aa, Homo sapiens
SSPPSFPRRRASLAPQLPAKMAENSESLGTVPEHERILQEIESTDTACVGPTLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKR

SEQ ID NO: 842198 - protein, 354 aa, Homo sapiens
MLYTYCFPNFILFCFKQRNTEGFLMLCLFHCCFTYFVRMFVENLPKLREDIKEISMSDLKDFLESIRKHSDKIGETAMKQAQHQKTFSVSLQKQNKMKFGKNMYINRDRIPEERNETVLKHSLEEEDENEEEILTVQDLVDFSPVYRCLHIYSVLGDEETFENYYRKQRKKQARLVLQPQSNMHETVDGYRRYFTQIVGFFVVEDHILHVTQGLVTRAYTDELWNMALSKIIAVLRAHSSYCTDPDLVLELKNLIVIFADTLQGYGFPVNRLFDLLFEIRDQYNETLLKKWAGVFRDIFEEDNYSPIPVVNEEEYKIVISKFPFQDPDLEKQVFPPKKEKFPPMGPQGSKWPLQ

SEQ ID NO: 842199 - protein, 217 aa, Homo sapiens
SFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGSCSAV

SEQ ID NO: 842200 - protein, 515 aa, Homo sapiens
SSPPSFPRRRASLAPQLPAKMAENSESLGTVPEHERILQEIESTDTACVGPTLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKRYYSALKTMEQLENVYFPWVSQYRFCQLMIENLPKLREDIKEISMSDLKDFLESIRKHSDKIGETAMKQAQHQKTFSVSLQKQNKMKFGKNMYINRDRIPEERNETVLKHSLEEEDENEEEILTVQDLVDFSPVYRCLHIYSVLGDEETFENYYRKQRKKQARLVLQPQSNMHETVDGYRRYFTQIVGFFVVEDHILHVTQGLVTRAYTDELWNMALSKIIAVLRAHSSYCTDPDLVLELKNLIVIFADTLQGYGFPVNRLFDLLFEIRDQYNETLLKKWAGVFRDIFEEDNYSPIPVVNEEEYKIVISKFPFQDPDLEKQVFPPKKEKFPPMGPQGSKWPLQ

SEQ ID NO: 842201 - protein, 173 aa, Homo sapiens; identical to SEQ ID NO: 842197

SEQ ID NO: 842202 - protein, 82 aa, Homo sapiens
SYGSGSKGTTGREDPIVSLPGMAEEQTAQQREGPEACVHRGKVEDGKCRASLSSQSQSSLNFSQHWVYCWQPCCQEQPQGPH

SEQ ID NO: 842203 - protein, 515 aa, Homo sapiens
EHLAPATALSPHLTRKAARAGIFQSQAVCSPAGQCDCASLPDWPRVAGCVRRRLPLLLRAGARRGRRCFVLSEARKFDRAAMPNRKASRNAYYFFVQEKIPELRRRGLPVARVADAIPYCSSDWALLREEEKEKYAEMAREWRAAQGKDPGPSEKQKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQKLRVGSSGFSHFNSSNEEQRSNTPIGDYPSRAKISGQNSSVRGRGITRLLESISNSSSNIHKFSNCDTSLSPYMSQKDGYKSFSSLS

SEQ ID NO: 842204 - protein, 374 aa, Homo sapiens
EHLAPATALSPHLTRKAARAGIFQSQAVCSPAGQCDCASLPDWPRVAGCVRRRLPLLLRAGARRGRRCFVLSEARKFDRAAMPNRKASRNAYYFFVQEKIPELRRRGLPVARVADAIPYCSSDWALLREEEKEKYAEMAREWRAAQGKDPGPSEKQKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRESCSVTPAGIQ

SEQ ID NO: 842205 - protein, 515 aa, Homo sapiens; identical to SEQ ID NO: 842203

SEQ ID NO: 842206 - protein, 374 aa, Homo sapiens; identical to SEQ ID NO: 842204

SEQ ID NO: 842207 - protein, 484 aa, Homo sapiens
EHLAPATALSPHLTRKAARAGIFQSQAVCSPAGQCDCASLPDWPRVAGCVRRRLPLLLRAGARRGRRCFVLSEARKFDRAAMPNRKASRNAYYFFVQEKIPELRRRGLPVARVADAIPYCSSDWAKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQKLRVGSSGFSHFNSSNEEQRSNTPIGDYPSRAKISGQNSSVRGRGITRLLESISNSSSNIHKFSNCDTSLSPYMSQKDGYKSFSSLS

SEQ ID NO: 842208 - protein, 69 aa, Homo sapiens
GPMISLQRKAHWEGTEEGPRAGGHAADLAWCREARDLCSSLSLGEASSPARMTAVFSQGQFCTVAAGCR

SEQ ID NO: 842209 - protein, 513 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQGHCSQMCHNVFIVESVCVGWFSLEFLLRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSIFHTFSRSYLELKQEQERVMFRRAQFLIKTKSQLSVSQDSDILFGSASSDTRDNN

SEQ ID NO: 842210 - protein, 513 aa, Homo sapiens; identical to SEQ ID NO: 842209

SEQ ID NO: 842211 - protein, 513 aa, Homo sapiens; identical to SEQ ID NO: 842209

SEQ ID NO: 842212 - protein, 275 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQVRAHAPRGNAPPRGKGL

SEQ ID NO: 842213 - protein, 266 aa, Homo sapiens
LLRRAPGALGARRGPGGRDGAAVAPRAGAEPGPGTEVWRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSIFHTFSRSYLELKQEQERVMFRRAQFLIKTKSQLSVSQDSDILFGSASSDTRDNN

SEQ ID NO: 842214 - protein, 275 aa, Homo sapiens; identical to SEQ ID NO: 842212

SEQ ID NO: 842215 - protein, 207 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYGSSAQPRPPQPLCVFPSIRRCLVLFTMQITCPAKTCFMGLPGEKKKKYKQQKQH

SEQ ID NO: 842216 - protein, 513 aa, Homo sapiens; identical to SEQ ID NO: 842209

SEQ ID NO: 842217 - protein, 513 aa, Homo sapiens; identical to SEQ ID NO: 842209

SEQ ID NO: 842218 - protein, 488 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPSLREEEEQGHCSQMCHNVFIVESVCVGWFSLEFLLRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSIFHTFSRSYLELKQEQERVMFRRAQFLIKTKSQLSVSQDSDILFGSASSDTRDNN

SEQ ID NO: 842219 - protein, 207 aa, Homo sapiens; identical to SEQ ID NO: 842215

SEQ ID NO: 842220 - protein, 119 aa, Homo sapiens
MGPVLPLSTCKHQEARGLRLSVHTWSLGDAIQAAGCKYQPWTDNSYITSFPRSPDWHAHCLLHVSSEATDPSNPAGLSSCCLEQFLLCLFPPPDPRGIPLSLPTSLAYPGSPHSCPHFP

SEQ ID NO: 842221 - protein, 108 aa, Homo sapiens
MPFLASSLSSYDFLLTTRFPLFMDTAIIPSTRPANIPPLHAKGRPLMFLPPNPGTPFSGYVGCHPINYTVASRFSALNELLTNFKSPTEMNLTCRSSTSTLGPGRHSS

SEQ ID NO: 842222 - protein, 449 aa, Homo sapiens
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYIIKLEPIETNQNAVFQYISRTDNPIEVTESSSTPEQTEVQIQETSTEQSKTVPVTDTEVETVEPPPVEIVTDEVAPTSDEQPQESQADLETSDNSDFGHQLICCLCRKEFNSRRGVRRHIRKVHKKKMEELKKYIETRKNPNQSSKGRSKNVLVPLSRSCPVCCKSFATKANVRRHFDEVHRGLRRDSITPDIATKPGQPLFLDSISPKKSFKTRKQKSSSKAEYNLTACKCLLCKRKYSSQIMLKRHMQIVHKITLSGTNSKREKGPNNTANSSEIKVKVEPADSVESSPPSITHSPQNELKGTNHSNEKKNITGSTEK

SEQ ID NO: 842223 - protein, 665 aa, Homo sapiens
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYIIKLEPIETNQNAVFQYISRTDNPIEVTESSSTPEQTEVQIQETSTEQSKTVPVTDTEVETVEPPPVEIVTDEVAPTSDEQPQESQADLETSDNSDFGHQLICCLCRKEFNSRRGVRRHIRKVHKKKMEELKKYIETRKNPNQSSKGRSKNVLVPLSRSCPVCCKSFATKANVRRHFDEVHRGLRRDSITPDIATKPGQPLFLDSISPKKSFKTRKQKSSSKAEYNLTACKCLLCKRKYSSQIMLKRHMQIVHKITLSGTNSKREKGPNNTANSSEIKVKVEPADSVESSPPSITHSPQNELKGTNHSNEKKNTPAAQKNKVKQDSESPKSTSPSAAGGQQKTRKPKLSAGFDFKQLYCKLCKRQFTSKQNLTKHIELHTDGNNIYVKFYKCPLCTYETRRKRDVIRHITVVHKKSSRYLGKITASLEIRAIKKPIDFVLNKVAKRGPSRDEAKHSDSKHDGTSNSPSKKYEVADVGIEVKVTKNFSLHRCNKCGKAFAKKTYLEHHKKTHKANASNSPEGNKTKGRSTRSKALVW

SEQ ID NO: 842224 - protein, 141 aa, Homo sapiens
LRPGSVSRSLSLPESLCFPLPTRSAAVARALRRRGRQRKREADLIKFPETTTTTEKAQGGGRPPFSSAPLLKPEGPLQVERRWWDPGCGGSRCPGEGSLRSCPLRFRLLRWWRRQLLPGGSSCQLPPPARLPPSHTARRTP

SEQ ID NO: 842225 - protein, 664 aa, Homo sapiens
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYIIKLEPIETNQNAVFQYISRTDNPIEVTESSSTPEQTEVQIQETSTEQSKTVPVTDTEVETVEPPPVEIVTDEVAPTSDEQPQESQADLETSDNSDFGHQLICCLCRKEFNSRRGVRRHIRKVHKKKMEELKKYIETRKNPNQSSKGRSKNVLVPLSRSCPVCCKSFATKANVRRHFDEVHRGLRRDSITPDIATKPGQPLFLDSISPKKSFKTRKQKSSSKAEYNLTACKCLLCKRKYSSQIMLKRHMQIVHKITLSGTNSKREKGPNNTANSSEIKVKVEPADSVESSPPSITHSPQNELKGTNHSNEKKNTPAAQKNKVKQDSESPKSTSPSAAGGQQKTRKPKLSAGFDFKQLYCKLCKRQFTSKQNLTKHIELHTDGNNIYVKFYKCPLCTYETRRKRDVIRHITVVHKKSSRYLGKITASLEIRAIKKPIDFVLNKVAKRGPSRDEAKHSDSKHDGTSNSPSKKYEVADVGIEVKVTKNFSLHRCNKCGKAFAKKTYLEHHKKTHKANASNSPEGNKTKGRSTRSKALV

SEQ ID NO: 842226 - protein, 493 aa, Homo sapiens
EYEADSVKSYGTGTDTMRGREPPPVEIVTDEVAPTSDEQPQESQADLETSDNSDFGHQLICCLCRKEFNSRRGVRRHIRKVHKKKMEELKKYIETRKNPNQSSKGRSKNVLVPLSRSCPVCCKSFATKANVRRHFDEVHRGLRRDSITPDIATKPGQPLFLDSISPKKSFKTRKQKSSSKAEYNLTACKCLLCKRKYSSQIMLKRHMQIVHKITLSGTNSKREKGPNNTANSSEIKVKVEPADSVESSPPSITHSPQNELKGTNHSNEKKNTPAAQKNKVKQDSESPKSTSPSAAGGQQKTRKPKLSAGFDFKQLYCKLCKRQFTSKQNLTKHIELHTDGNNIYVKFYKCPLCTYETRRKRDVIRHITVVHKKSSRYLGKITASLEIRAIKKPIDFVLNKVAKRGPSRDEAKHSDSKHDGTSNSPSKKYEVADVGIEVKVTKNFSLHRCNKCGKAFAKKTYLEHHKKTHKANASNSPEGNKTKGRSTRSKALV

SEQ ID NO: 842227 - protein, 215 aa, Homo sapiens
SGLYCTPLKKTLPLIYQYKKDPLRGGGHFCVMATSLLGEEPRLGSTPLAMLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSGGSSAHSQDGSHQPVFISKVHTSVDGLQGIYPRVGMAHPYESWFKPSHPGLGAAGEVGSAGAS

SEQ ID NO: 842228 - protein, 189 aa, Homo sapiens
SPPPLLLLSSSQEEPRLGSTPLAMLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSGGSSAHSQDGSHQPVFISKVHTSVDGLQGIYPRVGMAHPYESWFKPSHPGLGAAGEVGSAGAS

SEQ ID NO: 842229 - protein, 166 aa, Homo sapiens
MLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSGGSSAHSQDGSHQPVFISKVHTSVDGLQGIYPRVGMAHPYESWFKPSHPGLGAAGEVGSAGAS

SEQ ID NO: 842230 - protein, 100 aa, Homo sapiens
QPVPLLTAPGLCTNPLTHTALSKPGLTHSDTHTGAHHTQAQPPKPRPRSWSVRVHVARKCRLERPPCRPDPQPRTSWCPESVSPKGIGRSCRFHLPGWVP

SEQ ID NO: 842231 - protein, 115 aa, Homo sapiens
RPQDDIYSPSSSSKIPVKWTAPEAANYRVFSQKSDVWSFGVLLHEVFTYGQCPYEGMTNHETLQQIMRGYRLPRPAACPAEVYVLMLECWRSSPEERPSFATLREKLHAIHRCHP

SEQ ID NO: 842232 - protein, 976 aa, Homo sapiens
MAAEEVLQTVDHYKTEIERLTKELTETTHEKIQAAEYGLVVLEEKLTLKQQYDELEAEYDSLKQELEQLKEVAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKVSGEASVTVPTIDTYLLHSQGPQTPNIRVSSGTQRKRQFSPSLCDQSRPRTSGASYLQNLLRVPPDPTSTESFLLKGPPSMSEFIQGHRLSKEKRLTVAPPDCQQPAASVPPQCSQLAGRQDCPTVSPDTALPEEQPHSSSQCAPLHCLSKPPHP

SEQ ID NO: 842233 - protein, 244 aa, Homo sapiens
EPAPRLHHSAPAAAGPEGAGGARERESEPRAGARQTQGETAVTRPGRHGGRASLNKQNPEPLRYPRPPQPGPCRTAADRTQGPAPRTHAAAFAASPLTLCPVLHVAFLVSFSGGVAAAATRAGGASRCSFIRPHFLFRFHPSLPISFSLSPPASHPSPPPRNPLLPPSTGAMAAEEVLQTVDHYKTEIERLTKELTETTHEKIQAAEYGLVVLEEKLTLKQQYDELEAEYDSLKQELEQLKEVS

SEQ ID NO: 842234 - protein, 930 aa, Homo sapiens
MAAEEVLQTVDHYKTEIERLTKELTETTHEKIQAAEYGLVVLEEKLTLKQQYDELEAEYDSLKQELEQLKEVAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKSRPRTSGASYLQNLLRVPPDPTSTESFLLKGPPSMSEFIQGHRLSKEKRLTVAPPDCQQPAASVPPQCSQLAGRQDCPTVSPDTALPEEQPHSSSQCAPLHCLSKPPHP

SEQ ID NO: 842235 - protein, 762 aa, Homo sapiens
MQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKVSGEASVTVPTIDTYLLHSQGPQTPNIRVSSGTQRKRYACSDLHSTVQWPDFS

SEQ ID NO: 842236 - protein, 718 aa, Homo sapiens
MAAEEVLQTVDHYKTEIERLTKELTETTHEKIQAAEYGLVVLEEKLTLKQQYDELEAEYDSLKQELEQLKEVAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQAQCLLMKSVNAYEAPSI

SEQ ID NO: 842237 - protein, 135 aa, Homo sapiens
MLKIQRRLTHGPCLPEDSASWGCQDRNTITVQRYTCCNPSYENNQKSANPVSYGYLKLLNSGKTLHSQWTNKSTNKTEALGYLSQTINDFVFLFQKKNDKEKGGGPFWGEGVLPTTTTPLCGNRAAGAITWHAAG

SEQ ID NO: 842238 - protein, 114 aa, Homo sapiens
MAAEEVLQTVDHYKTEIERLTKELTETTHEKIQAAEYGLVVLEEKLTLKQQYDELEAEYDSLKQELEQLKEGVACHLSLSWPSLPPPARPTHHDQEVIKEVIERTVFSSRALCW

SEQ ID NO: 842239 - protein, 874 aa, Homo sapiens
MAAEEVLQTVDHYKTEIERLTKELTETTHEKIQAAEYGLVVLEEKLTLKQQYDELEAEYDSLKQELEQLKEVAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKVSGEASVTVPTIDTYLLHSQGPQTPNIRVSSGTQRKRYACSDLHSTVQWPDFS

SEQ ID NO: 842240 - protein, 718 aa, Homo sapiens; identical to SEQ ID NO: 842236

SEQ ID NO: 842241 - protein, 707 aa, Homo sapiens
MAAEEVLQTVDHYKTEIERLTKELTETTHEKIQAAEYGLVVLEEKLTLKQQYDELEAEYDSLKQELEQLKEVAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQVISFYW

SEQ ID NO: 842242 - protein, 154 aa, Homo sapiens
MAAEEVLQTVDHYKTEIERLTKELTETTHEKIQAAEYGLVVLEEKLTLKQQYDELEAEYDSLKQELEQLKEVGPLLEEKIERVHCFLPQEKNCLRNEYISWNLGGNGCLACGGGRLVRVIKSQHSKTTFKWVGMYKSNFSKPLLSQTQVSATIS

SEQ ID NO: 842243 - protein, 828 aa, Homo sapiens
FVTQLACFLANQQNKYKYEECKDLIKSMLRNERQFKEEKLAEQLKQAEELRQYKVLVHSQERELTQLREKLREGRDASRSLNQHLQALLTPDKPDKSQGQDLQEQLAEGCRLAQQLFQKLSPENDEDEDEDVQVEEAEKVLESSAPREVQKAEESKVPEDSLEECAITCSNSHGPCDSNQPHKNINITFEEDKVNSALVVDRESSHDECQDAVNILPVPGPTSSATNVSMVVSAGPLSSEKAEMNILEINEKLHPQLAEKKQQFRNLKEKCFVTQLACFLANQQNKYKNEECKDLIKSMLRNERQFKEEKLAEQLKQAEELRQYKVLVHSQERELTQLREKLREGRDASCSLNQHLQALLTPDEPDKSQGQDLQEQLAEGCRLAQHLVQKLSPENDNDDDEDVQVEVAEKVQKSSAPREMPKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSGTFHSLEEQQVCMAVDIGGHRWDQVKKEDQEATGPRLSRELLDEKGPEVLQDSLDRCYSTPSGYLELTDSCQPYRSAFYILEQQRVGWALDMDEIEKYQEVEEDQDPSCPRLSRELLDEKEPEVLQDSLDRCYSTPSGYLELPDLGQPYRSAVHSLEEQYLGLALDVDRIKKDQEEEEDQGPPCPRLSRELLEAVEPEVLQDSLDRCYSTPSSCLEQPDSCLPYGSSFYALEEKHVGFSLDVGEIEKKGKGKKRRGRRSTKKRRRRGRKEGEEDQNPPCPRLSRCAAG

SEQ ID NO: 842244 - protein, 371 aa, Homo sapiens
GKYLKNTSVFTENDNDDDEDVQVEVAEKVQKSSAPREMPKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSGTFHSLEEQQVCMAVDIGGHRWDQVKKEDQEATGPRLSRELLDEKEPEVLQDSLDRCYSTPSGYLELPDLGQPYRSAVHSLEEQYLGLALDVDRIKKDQEEEEDQGPPCPRLSRELLEAVEPEVLQDSLDRCYSTPSSCLEQPDSCLPYGSSFYALEEKHVGFSLDVGEIEKKGKGKKRRGRRSTKKRRRRGRKEGEEDQNPPCPRLSRCAAG

SEQ ID NO: 842245 - protein, 910 aa, Homo sapiens
VPGSSEVTRLGFATGSCCVPQTPPVSGMTRMRQFGFDPRIPPERKHPRARESWRARAPLHVSISFDRCKITSVSCGCDNRDLFYSNAHVVALSLYRIRHAHQVELRLPISETLSQMNRDQLQKFVQYLISAHHTEVLPTAQRLADEILLLGSEINLVNGAPDPTAGAGIEDANCWHLDEEQIQEQVKQLLSNGGYYGASQQLRSMFSKVREMLRMRDSNGARMLILMTEQFLQDTRLALWRQQGAGMTDKCRQLWDELGALWVCVVLSPHCKPEERAGWLQLLSRWDKLDVCPLEEGNYSFDGPSLQPTMAPAPELLQKGSTCITNTEGWVGHPLDPIGCLCRALLEACRLEEETLTLYPDSGPEKRKVAYQHVPVPGSPGESYLVLALEVALLGLGQQRALPEGLYAQDKVVRNEEQLLALLEEVELDERLVQVLRKQAGLLLEGGPFSGFGEVLFRESVPMHTCARYLFTALLPHDPDLAYRLALRAMRLPILETAFPAGEPHPSPLDSIMSNRFPRWFILGHLETRQCELASTMLTAAKGDPKWLHTVLGSIQQNIHSPALLFKLAQDACKTATPVSAPPDTTLLGIALELGLQVMRMTLNVMTWRRREMVRWLVSCATEIGPQALMNIMQNWYSLFTPVEAATIVAVTGTTHATLLRLQLDTSRREELWACARTLALQCAMKDPQNCALPALTLCEKNHSAFEAAYQIVLDAAAGGLGHAHLFTVARYMEHRGLPLRAYKLATLALAQLSIAFNQDSHPAVNDVLWACSLSHSLGRHELSAIVPLIIRSIHCAPMLSDILRRWTLSAPGLGPLGARRAAKPLGADRAPLCQLLDAAVTAYITTSHSRLTHISPRHYGDFIEFLGKARETFLLAPDGHLQFSQFLENLKQTYKGKKKLMLLVRERFG

SEQ ID NO: 842246 - protein, 685 aa, Homo sapiens
WNDAYLQRILASDSYGPSLTGSVGGDKPTFDPQGRPLWLGEPFPTACARVDTLRAHGYPRQALRLASAIINTLRLQQRHQLESYKQQKKELLQKGSTCITNTEGWVGHPLDPIGCLCRALLEACRLEEETLTLYPDSGPEKRKVAYQHVPVPGSPGESYLVLALEVALLGLGQQRALPEGLYAQDKVVRNEEQLLALLEEVELDERLVQVLRKQAGLLLEGGPFSGFGEVLFRESVPMHTCARYLFTALLPHDPDLAYRLALRAMRLPILETAFPAGEPHPSPLDSIMSNRFPRWFILGHLETRQCELASTMLTAAKGDPKWLHTVLGSIQQNIHSPALLFKLAQDACKTATPVSAPPDTTLLGIALELGLQVMRMTLNVMTWRRREMVRWLVSCATEIGPQALMNIMQNWYSLFTPVEAATIVAVTGTTHATLLRLQLDTSRREELWACARTLALQCAMKDPQNCALPALTLCEKNHSAFEAAYQIVLDAAAGGLGHAHLFTVARYMEHRGLPLRAYKLATLALAQLSIAFNQDSHPAVNDVLWACSLSHSLGRHELSAIVPLIIRSIHCAPMLSDILRRWTLSAPGLGPLGARRAAKPLGADRAPLCQLLDAAVTAYITTSHSRLTHISPRHYGDFIEFLGKARETFLLAPDGHLQFSQFLENLKQTYKGKKKLMLLVRERFG

SEQ ID NO: 842247 - protein, 910 aa, Homo sapiens; identical to SEQ ID NO: 842245

SEQ ID NO: 842248 - protein, 146 aa, Homo sapiens
MGASLCCPGWSRTLGLKRSSLLSFPKRWDYINPRLLTHWPFLQVEERFSRVPEPVQKRIVFWSFPRSEREICMYSSLGYPPPEGEHDARVPFTRGLHLLQSGAVDRVLQVGESLSPTPAGEARRSIPGLEMGELEGGLGPGDGRLQ

SEQ ID NO: 842249 - protein, 990 aa, Homo sapiens
MEPPAAKRSRGCPAGPEERDAGAGAARGRGRPEALLDLSAKRVAESWAFEQVEERFSRVPEPVQKRIVFWSFPRSEREICMYSSLGYPPPEGEHDARVPFTRGLHLLQSGAVDRVLQVGFHLSGNIREPGSPGEPERLYHVSISFDRCKITSVSCGCDNRDLFYSNAHVVALSLYRIRHAHQVELRLPISETLSQMNRDQLQKFVQYLISAHHTEVLPTAQRLADEILLLGSEINLVNGAPDPTAGAGIEDANCWHLDEEQIQEQVKQLLSNGGYYGASQQLRSMFSKVREMLRMRDSNGARMLILMTEQFLQDTRLALWRQQGAGMTDKCRQLWDELGALWVCVVLSPHCKPEERAGWLQLLSRWDKLDVCPLEEGNYSFDGPSLQPTMAPAPELLQKGSTCITNTEGWVGHPLDPIGCLCRALLEACRLEEETLTLYPDSGPEKRKVAYQHVPVPGSPGESYLVLALEVALLGLGQQRALPEGLYAQDKVVRNEEQLLALLEEVELDERLVQVLRKQAGLLLEGGPFSGFGEVLFRESVPMHTCARYLFTALLPHDPDLAYRLALRAMRLPILETAFPAGEPHPSPLDSIMSNRFPRWFILGHLETRQCELASTMLTAAKGDPKWLHTVLGSIQQNIHSPALLFKLAQDACKTATPVSAPPDTTLLGIALELGLQVMRMTLNVMTWRRREMVRWLVSCATEIGPQALMNIMQNWYSLFTPVEAATIVAVTGTTHATLLRLQLDTSRREELWACARTLALQCAMKDPQNCALPALTLCEKNHSAFEAAYQIVLDAAAGGLGHAHLFTVARYMEHRGLPLRAYKLATLALAQLSIAFNQDSHPAVNDVLWACSLSHSLGRHELSAIVPLIIRSIHCAPMLSDILRRWTLSAPGLGPLGARRAAKPLGADRAPLCQLLDAAVTAYITTSHSRLTHISPRHYGDFIEFLGKARETFLLAPDGHLQFSQFLENLKQTYKGKKKLMLLVRERFG

SEQ ID NO: 842250 - protein, 601 aa, Homo sapiens
MAPAPELLQKGSTCITNTEGWVGHPLDPIGCLCRALLEACRLEEETLTLYPDSGPEKRKVAYQHVPVPGSPGESYLVLALEVALLGLGQQRALPEGLYAQDKVVRNEEQLLALLEEVELDERLVQVLRKQAGLLLEGGPFSGFGEVLFRESVPMHTCARYLFTALLPHDPDLAYRLALRAMRLPILETAFPAGEPHPSPLDSIMSNRFPRWFILGHLETRQCELASTMLTAAKGDPKWLHTVLGSIQQNIHSPALLFKLAQDACKTATPVSAPPDTTLLGIALELGLQVMRMTLNVMTWRRREMVRWLVSCATEIGPQALMNIMQNWYSLFTPVEAATIVAVTGTTHATLLRLQLDTSRREELWACARTLALQCAMKDPQNCALPALTLCEKNHSAFEAAYQIVLDAAAGGLGHAHLFTVARYMEHRGLPLRAYKLATLALAQLSIAFNQDSHPAVNDVLWACSLSHSLGRHELSAIVPLIIRSIHCAPMLSDILRRWTLSAPGLGPLGARRAAKPLGADRAPLCQLLDAAVTAYITTSHSRLTHISPRHYGDFIEFLGKARETFLLAPDGHLQFSQFLENLKQTYKGKKKLMLLVRERFG

SEQ ID NO: 842251 - protein, 604 aa, Homo sapiens
VPGSSEVTRLGFATGSCCVPQTPPVSGMTRMRQFGFDPRIPPERKHPRARESWRARAPLHVSISFDRCKITSVSCGCDNRDLFYSNAHVVALSLYRIRHAHQVELRLPISETLSQMNRDQLQKFVQYLISAHHTEVLPTAQRLADEILLLGSEINLVNGAPDPTAGAGIEDANCWHLDEEQIQEQVKQLLSNGGYYGASQQLRSMFSKVREMLRMRDSNGARMLILMTEQFLQDTRLALWRQQGAGMTDKCRQLWDELGALWVCVVLSPHCKPEERAGWLQLLSRWDKLDVCPLEEGNYSFDGPSLQPTMAPAPELLQKGSTCITNTEGWVGHPLDPIGCLCRALLEACRLEEETLTLYPDSGPEKRKVAYQHVPVPGSPGESYLVLALEVALLGLGQQRALPEGLYAQDKVVRNEEQLLALLEEVELDERLVQVLRKQAGLLLEGGPFSGFGEVLFRESVPMHTCARYLFTALLPHDPDLAYRLALRAMRLPILETAFPAGEPHPSPLDSIMSNRFPRWFILGHLETRQCELASTMLTAAKGDPKWLHTVLGSIQQNIHSPALLFKLAQDACKTATPVSAPPDTTLLGIALELGLQVMRLTLD

SEQ ID NO: 842252 - protein, 314 aa, Homo sapiens [sequence omitted]

SEQ ID NO: 842253 - protein, 224 aa, Homo sapiens
MTLTLPGKPWRTEQTEDLKRVLRAVDRAIPLVLVSGNHDIGNTPTAETVEEFCRTWGDDYFSFWVGGVLFLVLNSQFYENPSKCPSLKQAQDQWLDEQLSIARQRHCQHAIVFQHIPLFLESIDEDDDYYFNLSKSTRKKLADKFIHAGVRVVFSGHYHRNAGGTYQNLDMVVSSAIGCQLGRDPHGLRVVVVTAEKIVHRYYSLDELSEKGIEDDLMDLIKKK

SEQ ID NO: 842254 - protein, 314 aa, Homo sapiens [sequence omitted]

SEQ ID NO: 842255 - protein, 187 aa, Homo sapiens
MSAAEAGGVFHRARGRTLAAFPAEKESEWKGPFYFILGADPQFGLIKAWSTGDCDNGGDEWEQEIRLTEQAVQAINKLNPKPKFFVLCGDLIHAMPGKPWRTEQTEDLKRVLRAVDRGRTVHCRAGEGRTGTIVVIDAMLDHEALQNRKVGRVQADVSRIRAQQVQMVQTDMQMSSYTKRFMEHDLY

SEQ ID NO: 842256 - protein, 314 aa, Homo sapiens [sequence omitted]

SEQ ID NO: 842257 - protein, 226 aa, Homo sapiens
MDVTLTLPGKPWRTEQTEDLKRVLRAVDRAIPLVLVSGNHDIGNTPTAETVEEFCRTWGDDYFSFWVGGVLFLVLNSQFYENPSKCPSLKQAQDQWLDEQLSIARQRHCQHAIVFQHIPLFLESIDEDDDYYFNLSKSTRKKLADKFIHAGVRVVFSGHYHRNAGGTYQNLDMVVSSAIGCQLGRDPHGLRVVVVTAEKIVHRYYSLDELSEKGIEDDLMDLIKKK

SEQ ID NO: 842258 - protein, 172 aa, Homo sapiens [sequence omitted]

SEQ ID NO: 842259 - protein, 253 aa, Homo sapiens
MSAAEAGGVFHRARGRTLAAFPAEKESEWKGPFYFILGADPQFGLIKAWSTGDCDNGGDEWEQEIRLTEQAVQAINKLNPKPKFFVLCGDLIHAMPGKPWRTEQTEDLKRVLRAVDRAIPLVLVSGNHDIGNTPTAETVEEFCRTWGDDYFSFWVGGVLFLVLNSQFYENPSKCPSLKQAQDQWLDEQLSIARQRHCQHAIVFQHIPLFLESIDEDDDYYFNLSKSTRKKLADKFIHAGVDIAEVEVVVVATQ

SEQ ID NO: 842260 - protein, 112 aa, Homo sapiens [sequence omitted]

SEQ ID NO: 842261 - protein, 223 aa, Homo sapiens
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAP

SEQ ID NO: 842262 - protein, 48 aa, Homo sapiens
MGSLGLHEKTPQCAGSSFRLLPVSSRPRNMDPEVVQVRMTMGRIRGRG

SEQ ID NO: 842263 - protein, 207 aa, Homo sapiens
AIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITL

SEQ ID NO: 842264 - protein, 65 aa, Homo sapiens
VKYAGVCDVGVRVCVQMHEWLSLHECYEKMCVRDHVRVSVHTCVCKCVGVKKCRRLGAHESLTVC

SEQ ID NO: 842265 - protein, 227 aa, Homo sapiens
LSVPAAARPAGVGPEHAAEPGPSLGRSAPAMASLLPLLCLCVVAAHLAGARDATPTEEPMATALGLERRSVYTGQPSPALEDWEEASEWTSWFNVDHPGGDGDFESLAAIRFYYGPARVCPRPLALEARTTDWALPSAVGERVHLNPTRGFWCLNREQPRGRRCSNYHVRFRCPLEASWGAWGPWGPCSGSCGPGRRLRRRHCPSPAGDACPGRPLEAQKCVRPRCP

SEQ ID NO: 842266 - protein, 88 aa, Homo sapiens
MIAGTGMLSRVALRTGALSHQILDRASSDRGAGYDYMAPGHATHPAVPMALGGGYHASPSGGGKALSESAGIPGMSYGEALKEGVAWP

SEQ ID NO: 842267 - protein, 289 aa, Homo sapiens
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKWVHLHLI

SEQ ID NO: 842268 - protein, 345 aa, Homo sapiens
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKAPRFKDFQQQDSQELLHYLLDAVRTEETKRIQASILKAFNNPTTKTADDETRKKVKDVTRQNV

SEQ ID NO: 842269 - protein, 182 aa, Homo sapiens
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTRPGPILIHLFSINCLGAHSESVC

SEQ ID NO: 842270 - protein, 289 aa, Homo sapiens; identical to SEQ ID NO: 842267

SEQ ID NO: 842271 - protein, 32 aa, Homo sapiens
WNSPESFIMDQLLFTLGYQYPRWWERLEGSFR

SEQ ID NO: 842272 - protein, 184 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRAVCALRPTLSHLPKGFGVAGCGGSCL

SEQ ID NO: 842273 - protein, 413 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842274 - protein, 413 aa, Homo sapiens; identical to SEQ ID NO: 842273

SEQ ID NO: 842275 - protein, 413 aa, Homo sapiens; identical to SEQ ID NO: 842273

SEQ ID NO: 842276 - protein, 413 aa, Homo sapiens; identical to SEQ ID NO: 842273

SEQ ID NO: 842277 - protein, 413 aa, Homo sapiens; identical to SEQ ID NO: 842273

SEQ ID NO: 842278 - protein, 413 aa, Homo sapiens; identical to SEQ ID NO: 842273

SEQ ID NO: 842279 - protein, 413 aa, Homo sapiens; identical to SEQ ID NO: 842273

SEQ ID NO: 842280 - protein, 413 aa, Homo sapiens; identical to SEQ ID NO: 842273

SEQ ID NO: 842281 - protein, 339 aa, Homo sapiens
MTEGVKTLGWTKQKGGCHWGRSEGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842282 - protein, 303 aa, Homo sapiens
MKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842283 - protein, 413 aa, Homo sapiens; identical to SEQ ID NO: 842273

SEQ ID NO: 842284 - protein, 308 aa, Homo sapiens
SWSLAIRIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842285 - protein, 434 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLAGESGKMHHRQSRLRSIPQDCVISRERDSPGAIRAGCSYYKTTSHIASLIDLISLYDTMDGSIALLDLTFSPITFQKLDRRPWDDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842286 - protein, 273 aa, Homo sapiens
RAAGIRHQLQIVFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842287 - protein, 243 aa, Homo sapiens
MATPRRNAGSTGRLSTATPSSPSWPLSKPWATCRSTLPTPPERYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842288 - protein, 413 aa, Homo sapiens; identical to SEQ ID NO: 842273

SEQ ID NO: 842289 - protein, 192 aa, Homo sapiens
RGSQALVSTQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842290 - protein, 385 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITRPSAGRPRASGTPALPSTELGSKGCSRQLPTSLRALPQRPWPQALLT

SEQ ID NO: 842291 - protein, 358 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITLRWVRWTCAAVQPAPHPSLT

SEQ ID NO: 842292 - protein, 182 aa, Homo sapiens
APPSVRGGREGASRSRSELPTRVLPAEGWWWERSGSGGAEPGRGPCGGRAAAGPADGGMGCTVSAEDKNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842293 - protein, 121 aa, Homo sapiens
MEEVIQAGLAQWSRQKGLALPWDRTRGHPDVPWRNLTSSPTRPLAQPAGSCMPAEPSPAAHYHQLHVHLQLLPSDLSERPGLRLAPLALVEVGMTLPVPQTPLPHVTQQQKLAPGRQLCPW

SEQ ID NO: 842294 - protein, 104 aa, Homo sapiens
MLVMAMVPPSGHLFWFLTIVLFCDEGRGAHAESPKAASGGAPASPAWTPSFAQHQPLPQPKSKCLQGASCPVPQPQPLGGPKGKSTRSVRRHHSWKPQSTCSFS

SEQ ID NO: 842295 - protein, 148 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLAAPAQVQMFTGSLLPSPPTPAARRPQRKKHKKRETPPFLETTVHLLILVAF

SEQ ID NO: 842296 - protein, 232 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQWL

SEQ ID NO: 842297 - protein, 159 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLGAGESGKSTIVKQMKIIHEDGYSEEECRQYRAVVYSNSPGGGQHSTAEVSLHVIKAAFDTND

SEQ ID NO: 842298 - protein, 115 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLAGESGKSTCSFSSFLRNG

SEQ ID NO: 842299 - protein, 88 aa, Homo sapiens
NSFSSRHRGSSGTAFSGLCRSLEGWRAGRQAVLGELQQDVTRRAKRPREGGPGTLRSKEAAGARPEGPAPAALAPGSINLKCSSLALT

SEQ ID NO: 842300 - protein, 413 aa, Homo sapiens; identical to SEQ ID NO: 842273

SEQ ID NO: 842301 - protein, 413 aa, Homo sapiens; identical to SEQ ID NO: 842273

SEQ ID NO: 842302 - protein, 355 aa, Homo sapiens
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842303 - protein, 338 aa, Homo sapiens
MIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842304 - protein, 344 aa, Homo sapiens
RNRRGGADIVVVVRNRRGRVVVVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842305 - protein, 339 aa, Homo sapiens
MEYAGHLPASSAQGTILACTSCTGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842306 - protein, 303 aa, Homo sapiens; identical to SEQ ID NO: 842282

SEQ ID NO: 842307 - protein, 316 aa, Homo sapiens
VRRPRGSPTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842308 - protein, 413 aa, Homo sapiens; identical to SEQ ID NO: 842273

SEQ ID NO: 842309 - protein, 413 aa, Homo sapiens; identical to SEQ ID NO: 842273

SEQ ID NO: 842310 - protein, 218 aa, Homo sapiens
MTLEECGLSNQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 842311 - protein, 373 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSMVGLVRGSS

SEQ ID NO: 842312 - protein, 344 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITRSTGIL

SEQ ID NO: 842313 - protein, 146 aa, Homo sapiens
CRPPTQIKGSTRHLFWGAQVIRDLARQVPVSCPDELKFSVSFSRFGNLRSAKARLLIFYLVCLRLECIKSAPLPRDKQACMYLGANKYDEAASYIQSKFEDLNKRKDTKEIYTHFTCATDTKNVQFVFDAVTDVIIKNNLKDCGLF

SEQ ID NO: 842314 - protein, 104 aa, Homo sapiens; identical to SEQ ID NO: 842294

SEQ ID NO: 842315 - protein, 117 aa, Homo sapiens
MRLNGIMKDSQSEMLVMAMVPPSGHLFWFLTIVLFCDEGRGAHAESPKAASGGAPASPAWTPSFAQHQPLPQPKSKCLQGASCPVPQPQPLGGPKGKSTRSVRRHHSWKPQSTCSFS

SEQ ID NO: 842316 - protein, 266 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYCTMVLLPDSPAPNSSNFTSRAAFSPSSRSFLSIIFSALGQSPVRSALTSSNRF

SEQ ID NO: 842317 - protein, 158 aa, Homo sapiens
APPSVRGGREGASRSRSELPTRVLPAEGWWWERSGSGGAEPGRGPCGGRAAAGPADGGMGCTVSAEDKAAAERSKMIDKNLREDGEKAAREVKLLLLGVRPRPALGSLIPSSNPQTRTLTSQTRASNSQTRAVWDPTPGPGPGLKTLDWTRPLILPRL

SEQ ID NO: 842318 - protein, 34 aa, Homo sapiens
MLTHTHTHTFIFPKFILTPILTPKDPNSPDPIPD

SEQ ID NO: 842319 - protein, 97 aa, Homo sapiens
LWASYVCRLHTPVGFIHLRAAYTCRLHTPVGFIHLWASYVCRLHTPVGFIHLRAAYTCGLHAPVDCMHLWTAYTCGLHTPVGCIHLWTACLLVEGFY

SEQ ID NO: 842320 - protein, 246 aa, Homo sapiens
LGGTWTAVLELSRLPVDCCQLPVASRFSESWQRLFHRVLLEAEPKSGCDSGDGVEHPAGQARTAPATQHRRIRPCLCGERLERKSPAWEPSEQPCRTGWGLLYDRPLRPENCWEAVARGGTQMLEEGVLPSPGPALPQEENTGEEGMAAGLLTAGPRGSTFFSSVTVAFAQERWRCLVSTPRDRFKEGIPGKSRSLVLLGLPVSQPGMNSQLEQREGAWMLEGEDLRSPSPGWKIISGITTRAKPF

SEQ ID NO: 842321 - protein, 98 aa, Homo sapiens
MEAQELNKKETLNDRIQDPIIWSPACKRKEQEPNKDRNNSQKKSRLVFTDLQRRTLFAIFKENKRPSKEMQITISQQLGLELTTVSNFFMNARRRSLE

SEQ ID NO: 842322 - protein, 258 aa, Homo sapiens
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTGLILSFLVPWMWGGPRGRVGSAPDRPGPRGYLLLFGAVGAAGSPR

SEQ ID NO: 842323 - protein, 322 aa, Homo sapiens
PTRSPERREYDAIRMNLSCSLLFSKVWRLQNDFAEPERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQWKKNSKGRLTMKEGTQSSTSESMEVGPSRRWDTDAASLDVLWDEHDLTQNTAAFNTNLRDARAQERHRGGQTGEQPERGESDIHKPRPGQRWNSRKEKESKAKGDNNAGKTATGQRTTERR

SEQ ID NO: 842324 - protein, 678 aa, Homo sapiens
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 842325 - protein, 662 aa, Homo sapiens
MAANVGSMFQYWKRFDLQQLQRELDATATVLANRQDESEQSRKRLIEQSREFKKNTPEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 842326 - protein, 1519 aa, Homo sapiens
APAAPGQPRDSARWMLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGSARRKGKDQPESRRPGSLPAPPPSQLPRNPGEQASNTNGTHQFSPAGLSQDFFSSSLASPSLPLASTGKFALNSLLQRQLMQSFYSKAMQEAGSTSMIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 842327 - protein, 678 aa, Homo sapiens; identical to SEQ ID NO: 842324

SEQ ID NO: 842328 - protein, 1414 aa, Homo sapiens
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 842329 - protein, 472 aa, Homo sapiens
MLLVVACFDRFKKGRKNHLNHFSFLFSTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 842330 - protein, 693 aa, Homo sapiens
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRPPGRGSPEPAGMSWRARERQEKDVLPPSAVPHPPPLASLKTAADDKRARPHPAQAPHTLLPGPPRVVAGTSEVGRGAGMSQVCLRQSFFILYCYFYYFEFKPDLHSIFPTGKSGPAAFPAGWGWN

SEQ ID NO: 842331 - protein, 1183 aa, Homo sapiens
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQSPSTPRLCRKPEAQALIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 842332 - protein, 255 aa, Homo sapiens
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKSGRGESDLPHAARFHPGTL

SEQ ID NO: 842333 - protein, 294 aa, Homo sapiens
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKLKATRLNVLTGLERATEGEVLTERGDLGKGLIGQHSPAWVQVQRPQWAPQGDRCTKGR

SEQ ID NO: 842334 - protein, 619 aa, Homo sapiens
MLSSLFSFLSFLPFQIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 842335 - protein, 1519 aa, Homo sapiens; identical to SEQ ID NO: 842326

SEQ ID NO: 842336 - protein, 304 aa, Homo sapiens
MEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 842337 - protein, 1414 aa, Homo sapiens; identical to SEQ ID NO: 842328

SEQ ID NO: 842338 - protein, 239 aa, Homo sapiens
AEREYSVPIVRRHLLIASCHLQGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 842339 - protein, 124 aa, Homo sapiens
MVARLGGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 842340 - protein, 131 aa, Homo sapiens
YLPACICTHISHILSLTMDKSLCFCRGPDSSLGLQSLFLSSSAQKSPMSDHLTREARMNPPSGLQSLHDMATSHLPGLISQCSLLHSPHSSCLVSWLPLKHSRPALALGPWHFAGPLPLPWILSRFAVHLL

SEQ ID NO: 842341 - protein, 58 aa, Homo sapiens
MTFCVLISLDYPQHSSLWEEAVVRSKLGVVMDNENCVEDTGSDSLVRTLKRRAGGHLM

SEQ ID NO: 842342 - protein, 69 aa, Homo sapiens
QFGASIDDIQGFSETSFLDKAYHFTMQASYIIFVDLQYLIDRLESTQEVAVLAVPVHFTPHSTGTETPP

SEQ ID NO: 842343 - protein, 38 aa, Homo sapiens
VDQAVDPKREAQDKGPGGTKPTKSVLPAKGQKVPLEQK

SEQ ID NO: 842344 - protein, 83 aa, Homo sapiens
EPQAYHLHPESCVTMWVPVVFLTLSVTWIGAAPLILSRIVGGWECEKHSQPWQVLVASRGRAVCGGVLVHPQWVLTAAHCIRK

SEQ ID NO: 842345 - protein, 187 aa, Homo sapiens
MVGGMQEREPALTVKLRLFPPKPSTPAQTGSWALFCLSQPHSKPIPPAPPYCNSPHSHTRSPLPPTYARTFSPLPSQLPAPSCFTKGEVPGHLRVSLCGAQNLQGPLSMPLVPWTVSLVHLLRPSILSQSTDFSHSAVSAQPYPRDLDAWPPNLALGYPDATRHLLLPSQAIWPETTNGSLSLAMGL

SEQ ID NO: 842346 - protein, 187 aa, Homo sapiens; identical to SEQ ID NO: 842345

SEQ ID NO: 842347 - protein, 117 aa, Homo sapiens
TFFFIWLCGLENTFLSQRSEVPRTDQPRAHWSESSSGSMAAQPHPQAAACHPRWHVPSSYPGSGKTWLLLGSYYSVLSTSLQSLGFLPSNINFVIYLLENNHKNLKSKLSKGVSHNP

SEQ ID NO: 842348 - protein, 256 aa, Homo sapiens
MVEAEELAQLRLLNLELLRQLWVGQDAVRRSVARAASESSLESSSSYNSETPSTPETSSTSLSTSCPRGRSSVWGPPDACRGDLRDVARSGVASLPPAKCQHQESLGRPRPHSAPSLGTSSLRDPEPSGRLGDPGPQEAQTPRSILAQQSKLSKPRVTFSEESAVPERSWRLRPYLGYDWIAGSLDTSSSITSQPEAFFSKLQEFRETNKEECICSHPEPQLPGLRESSGSGVEEDHECECGPSARPLSSPASRCP

SEQ ID NO: 842349 - protein, 388 aa, Homo sapiens
MVEAEELAQLRLLNLELLRQLWVGQDAVRRSVARAASESSLESSSSYNSETPSTPETSSTSLSTSCPRGRSSVWGPPDACRGDLRDVARSGVASLPPAKCQHQESLGRPRPHSAPSLGTSSLRDPEPSGRLGDPGPQEAQTPRSILAQQSKLSKPRVTFSEESAVPERSWRLRPYLGYDWIAGSLDTSSSITSQPEAFFSKLQEFRETNKEECICSHPEPQLPGLRESSGSGVEEDHECVYCYRVNRRLFPVPVDPGTPCRLCRTPRDQQGPGTLAQPAHVRVSIPLSILEPPHRYHIHRRKSFDASDTLALPRHCLLGWDIFPPKSEKSSAPRNLDLWSSVSAEAQHQKLSGTSSPFHPASPMQMLPPTPTWSVPQVPRPHVPRQKP

SEQ ID NO: 842350 - protein, 415 aa, Homo sapiens
MVEAEELAQLRLLNLELLRQLWVGQDAVRRSVARAASESSLESSSSYNSETPSTPETSSTSLSTSCPRGRSSVWGPPDACRGDLRDVARSGVASLPPAKCQHQESLGRPRPHSAPSLGTSSLRDPEPSGRLGDPGPQEAQTPRSILAQQSKLSKPRVTFSEESAVPERSWRLRPYLGYDWIAGSLDTSSSITSQPEAFFSKLQEFRETNKEECICSHPERAGAGEGGRGRLSGSIPRPAHPPRPLRPQLPGLRESSGSGVEEDHECVYCYRVNRRLFPVPVDPGTPCRLCRTPRDQQGPGTLAQPAHVRVSIPLSILEPPHRYHIHRRKSFDASDTLALPRHCLLGWDIFPPKSEKSSAPRNLDLWSSVSAEAQHQKLSGTSSPFHPASPMQMLPPTPTWSVPQVPRPHVPRQKP

SEQ ID NO: 842351 - protein, 154 aa, Homo sapiens [sequence omitted]

SEQ ID NO: 842352 - protein, 104 aa, Homo sapiens
LKLPLLNSAYPVPQLTNRSSPFRGPPHSRNRPPHRPRKLTNRLCSSALSPAPTLKLTLRIAEYTLTRRPGPAPHLTNQDGRPRPLERLRRLRLLRRRMLGDSAG

SEQ ID NO: 842353 - protein, 388 aa, Homo sapiens; identical to SEQ ID NO: 842349

SEQ ID NO: 842354 - protein, 282 aa, Homo sapiens [sequence omitted]

SEQ ID NO: 842355 - protein, 388 aa, Homo sapiens
MTSRPCPSPDQSRRPAEAPGTAQAAAAATAAHARGFCRSSLESSSSYNSETPSTPETSSTSLSTSCPRGRSSVWGPPDACRGDLRDVARSGVASLPPAKCQHQESLGRPRPHSAPSLGTSSLRDPEPSGRLGDPGPQEAQTPRSILAQQSKLSKPRVTFSEESAVPERSWRLRPYLGYDWIAGSLDTSSSITSQPEAFFSKLQEFRETNKEECICSHPEPQLPGLRESSGSGVEEDHECVYCYRVNRRLFPVPVDPGTPCRLCRTPRDQQGPGTLAQPAHVRVSIPLSILEPPHRYHIHRRKSFDASDTLALPRHCLLGWDIFPPKSEKSSAPRNLDLWSSVSAEAQHQKLSGTSSPFHPASPMQMLPPTPTWSVPQVPRPHVPRQKP

SEQ ID NO: 842356 - protein, 104 aa, Homo sapiens; identical to SEQ ID NO: 842352

SEQ ID NO: 842357 - protein, 257 aa, Homo sapiens
MSAPSDLEMIGNEDLEFTRANQRRRHVTSHRSSSFTLLQSLAIEDSRDKPTYSVLLGQLFAFIGTNPDQAVSSSSFLLAAQTRWRRGNTRKQALVHMRELLTAAVRVGGVTHLVGPVTMVLQGGPRIEELTCGGMVEQVQEAFGETMTSVVSLCARYPIACANSIGLLCTIPYTRSEEKCLVRSGLVQLMDRLCSLSNQTESSSSEKQTKKQKVATMAWAAFQVLANRCVEWEKEEGGFPRGCALSGWPAHPYWPGT

SEQ ID NO: 842358 - protein, 327 aa, Homo sapiens
MSAPSDLEMIGNEDLEFTRANQRRRHVTSHRSSSFTLLQSLAIEDSRDKPTYSVLLGQLFAFIGTNPDQAVSSSSFLLAAQTRWRRGNTRKQALVHMRELLTAAVRVGGVTHLVGPVTMVLQGGPRIEELTCGGMVEQVQEAFGETMTSVVSLCARYPIACANSIGLLCTIPYTRSEEKCLVRSGLVQLMDRLCSLSNQTESSSSEKQTKKQKVATMAWAAFQVLANRCVEWEKEEGGSTEAVHSGLARQVSSLLTNHLARATECCGNQAAGNDALQDVLSLLNDLSRSHIGKAILSQPACVSKLLSLLLDQRPSPKLVLIILQLCR

SEQ ID NO: 842359 - protein, 102 aa, Homo sapiens
MRGQVQWLTSVIPALWEAKKNLINLPALSSSLSIIASSEKPSLNGHPISPKALAIVGILSLSVQVINIYLSKYQRPILLCSSLYSQNSVWCIIWLNRNVLNE

SEQ ID NO: 842360 - protein, 32 aa, Homo sapiens
GFCSERLELALGTLPLMVKSTSAPGGCNLCPP

SEQ ID NO: 842361 - protein, 146 aa, Homo sapiens
AGQVSCVRLQCPPLPCKLQVTERGSCCPRCRGCLAHGEEHPEGSRWVPPDSACSSCVCHEGVVTCARIQCISSCAQPRQGPHDCCPQCSDCEHEGRKYEPGESFQPGADPCEVCICEPQPEGPPSLRCHRRQCPSLVGCPPSQLLP

SEQ ID NO: 842362 - protein, 102 aa, Homo sapiens
SVDANSHSYDVEMQVQNDSYVINSERLGPKESSPSAVRPTSTTCCLTSSRKPTLIPLVPASDTEATSGGCHPPLGTSPWVASPDPPLGSGGSISAPLLLAPF

SEQ ID NO: 842363 - protein, 134 aa, Homo sapiens
PPEPGEPGLQGRAPQVRTQLRGHQARSQSRSAAGQRSAHGSTRCDYSYLLENSRPGPPHVLQGDSETLWAGGTFSSIWTLAASQADVTHPLGLRHGSLAQTLPLVPVVPFLPLCCWPPSEDARASPGPLLQSLV

SEQ ID NO: 842364 - protein, 73 aa, Homo sapiens
HTRPENVEWPPSGLGCHLHHITRDRSPVFFGNHVPRTPPDCLPEHTKINEAQNPVPTSFHEEQVVHQRDGPHE

SEQ ID NO: 842365 - protein, 94 aa, Homo sapiens
QTGIPPQRTPHTGQDGCGFSVPTVQNVVPTQPPVAPRSVSVWNHHFLVHTDPPSMFPGSHICLNRPVSVSWCLLSGRMQHRGKEVIMSGGSWHW

SEQ ID NO: 842366 - protein, 133 aa, Homo sapiens
LSCDPGILSAPSELAVLPLPLLLYQRPNQSCGNADEREYLCSGKWLEFILEESPGDSLPGMGDSVGNSTEVECSRCQESEPGFKLEMDEGVMGDRAQQQEGRRWQSTCACWGAEGPAGLPPEVCCGKTTRWGQ

SEQ ID NO: 842367 - protein, 270 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQTYYRAKGGEKPWGKKKIWGGGGGKKTPKG

SEQ ID NO: 842368 - protein, 732 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 842369 - protein, 678 aa, Homo sapiens
EALYTAMKGFGSDKEAILDIITYGATGRGDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 842370 - protein, 643 aa, Homo sapiens
LLSPIPGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 842371 - protein, 709 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEGDTSGDFLKALLALCGGED

SEQ ID NO: 842372 - protein, 732 aa, Homo sapiens; identical to SEQ ID NO: 842368

SEQ ID NO: 842373 - protein, 732 aa, Homo sapiens; identical to SEQ ID NO: 842368

SEQ ID NO: 842374 - protein, 525 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLNELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 842375 - protein, 667 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIGNWQGLREGLGALGT

SEQ ID NO: 842376 - protein, 332 aa, Homo sapiens [sequence omitted]

SEQ ID NO: 842377 - protein, 398 aa, Homo sapiens
CPSPFVCPSPFVCPSPFVCPSPFVCPSPFVKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 842378 - protein, 591 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKIVPAPETKEGAGVGGGVGLGSYLQWSLGNAPTPTGHRGPSTAERLKNRSHRSCPPPLPSDPQAFPASSPCYSLCPGLGYVRSKNILNLCL

SEQ ID NO: 842379 - protein, 449 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDENASSSAP

SEQ ID NO: 842380 - protein, 312 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQVNKHKLDKSMKGAGTDEKTLTRIMVSRSEIDLLNIRREFIEKYDKSLHQAIEGDTSGDFLKALLALCGGED

SEQ ID NO: 842381 - protein, 376 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTI

SEQ ID NO: 842382 - protein, 131 aa, Homo sapiens
MAYPKFIESANIMDPDEQLETLHEALKLLPPAHCETLRYLMAHLKRVTLHEKENLMNAENLGIVFGPTLYKGAGTDEKTLTRIMVSRSEIDLLNIRREFIEKYDKSLHQAIEGDTSGDFLKALLALCGGED

SEQ ID NO: 842383 - protein, 312 aa, Homo sapiens; identical to SEQ ID NO: 842380

SEQ ID NO: 842384 - protein, 107 aa, Homo sapiens
ATCPARSPRLSSRSAARCGCCWANGLRSSERCVLESLRPCVRLRPEASAARGFCCEPETMAKPAQGAKYRGSIHDFPGFDPNHPLLQPLPWFGLCQIQKHPEPLSVK

SEQ ID NO: 842385 - protein, 109 aa, Homo sapiens
ATCPARSPRLSSRSAARCGCCWANGLRSSERCVLESLRPCVRLRPEASAARIFWGGPVESPASPHPASPIYFLGGDKAQDVVSTVIPEHACTPSPANRGEEVGGVSLCL

SEQ ID NO: 842386 - protein, 87 aa, Homo sapiens
CACPPSRLHHSTSPSFMVDSRPGHCAPLLLKSSFLLGGTEALSNLPVSLSDAVFDEYLKTTGKPIEASIRGELSGDFEKLMLAVGMS

SEQ ID NO: 842387 - protein, 99 aa, Homo sapiens
LEDPRVVLSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 842388 - protein, 732 aa, Homo sapiens; identical to SEQ ID NO: 842368

SEQ ID NO: 842389 - protein, 432 aa, Homo sapiens
MLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 842390 - protein, 753 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGRARVLDQEFGCLGSNLHLPCTCF

SEQ ID NO: 842391 - protein, 332 aa, Homo sapiens [sequence omitted]

SEQ ID NO: 842392 - protein, 666 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSPTRCVCYFQDLSSHLASSRAWVRL

SEQ ID NO: 842393 - protein, 327 aa, Homo sapiens
FLTSSPLKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 842394 - protein, 235 aa, Homo sapiens
MAEIIFALTFQGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 842395 - protein, 440 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGT

SEQ ID NO: 842396 - protein, 99 aa, Homo sapiens; identical to SEQ ID NO: 842387

SEQ ID NO: 842397 - protein, 259 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQPLATASALVWAMSDPKTS

SEQ ID NO: 842398 - protein, 228 aa, Homo sapiens
ATCPARSPRLSSRSAARCGCCWANGLRSSERCVLESLRPCVRLRPEASAARGFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREDT

SEQ ID NO: 842399 - protein, 66 aa, Homo sapiens
CLGEMMSKWLLGPWLEGMALGCQAGTLLARILMGGLDELGIPLSQERRTSERRLLLVAAVLVGLCV

SEQ ID NO: 842400 - protein, 200 aa, Homo sapiens
ALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQ

SEQ ID NO: 842401 - protein, 353 aa, Homo sapiens
PECSVEDSKLSLVLDKDEVAPQSAIHMDLPPERDGEKGRSTKPGFAMPKLALPKMKASKSGVSLPQRDVDPSLSSATAGGSFQDTEKASSDGGRGGLGATASATGSEGVNLHRPQVHIPSLGFAKPDLRSSKAKVEVSQPEADLPLPKHDLSTEGDSRGCGLGDVPVSQPCGEGIAPTPEDPLQPSCRKPDAEVLTVESPEEEAMTKYSQESWFKMPKFRMPSLRRSFRDRGGAGKLEVAQTQAPAATGGEAAAKVKEFLVSGSNVEAAMSLQLPEADAEVTASESKSSTDILRCDLDSTGLKLHLSTAGMTGDELSTSEVRIHPSKGPLPFQMPGMRLPETQVLPGEIDETP

SEQ ID NO: 842402 - protein, 272 aa, Homo sapiens
AAFAGRHGGLQGPEPLLPPPPRSPTSTHRGPVTATAKKVTAARVAVASVQGKMASATDSRYGQKESSDQNFDYMFKILIIGNSSVGKTSFLFRYADDSFTPAFVSTVGIDFKVKTIYRNDKRIKLQIWDTAGQERYRTITTAYYRGAMGFILMYDITNEESFNAVQDWSTQIKTYSWDNAQVLLVGNKCDMEDERVVSSERGRQLADHLGFEFFEASAKDNINVKQTFERLVDVICEKMSESLDTADPAVTGAKQGPQLSDQQVPPHQDCAC

SEQ ID NO: 842403 - protein, 196 aa, Homo sapiens
AAFAGRHGGLQGPEPLLPPPPRSPTSTHRGPVTATAKKVTAARVAVASVQGKDTAGQERYRTITTAYYRGAMGFILMYDITNEESFNAVQDWSTQIKTYSWDNAQVLLVGNKCDMEDERVVSSERGRQLADHLGFEFFEASAKDNINVKQTFERLVDVICEKMSESLDTADPAVTGAKQGPQLSDQQVPPHQDCAC

SEQ ID NO: 842404 - protein, 131 aa, Homo sapiens
FLFRYADDSFTPAFVSTVGIDFKVKTIYRNDKRIKLQIWVGPSWRAPARLGWIPVLGKAAPTSSISFLTGVIHLHTGHLSVRCPLCTGAETAPVFSHKHLILVPQFPHLQVLPCMRFQLDLGPHSLFLFVF

SEQ ID NO: 842405 - protein, 272 aa, Homo sapiens; identical to SEQ ID NO: 842402

SEQ ID NO: 842406 - protein, 233 aa, Homo sapiens
EFRVVAVASVQGKMASATDSRYGQKESSDQNFDYMFKILIIGNSSVGKTSFLFRYADDSFTPAFVSTVGIDFKVKTIYRNDKRIKLQIWDTAGQERYRTITTAYYRGAMGFILMYDITNEESFNAVQDWSTQIKTYSWDNAQVLLVGNKCDMEDERVVSSERGRQLADHLGFEFFEASAKDNINVKQTFERLVDVICEKMSESLDTADPAVTGAKQGPQLSDQQVPPHQDCAC

SEQ ID NO: 842407 - protein, 167 aa, Homo sapiens
AAFAGRHGGLQGPEPLLPPPPRSPTSTHRGPVTATAKKVTAARVAVASVQGKMASATDSRYGQKESSDQNFDYMFKILIIGNSSVGKTSFLFRYADDSFTPAFVSTVGIDFKVKTIYRNDKRIKLQIWDTAGQERYRTITTAYYRGAMGFILMYDITNEESFNAVQD

SEQ ID NO: 842408 - protein, 91 aa, Homo sapiens
IDPPKDITISNVTKDSVMVSWSPPVASFDYYRVSYRPTQVGRLDSSVVPNTVTEFTITRLNPATEYEISLNSVRGREESERICTLVHTGGN

SEQ ID NO: 842409 - protein, 105 aa, Homo sapiens [sequence omitted]

SEQ ID NO: 842410 - protein, 109 aa, Homo sapiens
MLQAGPVLGTSHSGSPRVCMSPSALCCAHTVWVVLSVESACVVATGMWKPWAACGSRCWCHSAQTRGRPLPLLYEALVPVTYISFPSFLPSEKCTVLGAHRKTLYTFTP

SEQ ID NO: 842411 - protein, 343 aa, Homo sapiens
MKMEEAVGKVEELIESEAPPKASEQETAKEEDGSVELESQVQKDGVADSTVISSMPCLLMELRRDSSESQLASTESDKPTTGRVYESDSSNHCMLSPSSSGHLADSDTLSSAEENEPSQAETAVEGDPSGVSGATVGRKSRRSRSESETSTMAAKKNRQSSDKQNGRVAKVKGHRSQKHKERIRLLRQKREAAARKKYNLLQDSSTSDSDLTCDSSTSSSDDDEEVSGSSKTITAEIPGHLDPGFLASDKTSAGNAPLNEEINIASSDSEVEIVGVQEHARCVHPRGGVIQSVSSWKHGSGTQYVSTRQTQSWTAVTPQQTWASPAEVVDLTLDEDSRRKYLL

SEQ ID NO: 842412 - protein, 156 aa, Homo sapiens
MSDTNSDPEVVNVDNLLAAAVVQEHSNSVGGQDTGATWRTSGLLEELNAEAGHLDPGFLASDKTSAGNAPLNEEINIASSDSEVEIVGVQEHARCVHPRGGVIQSVSSWKHGSGTQYVSTRQTQSWTAVTPQQTWASPAEVVDLTLDEDSRRKYLL

SEQ ID NO: 842413 - protein, 283 aa, Homo sapiens
MKMEEAVGKVEELIESEAPPKASEQETAKEEDGSVELESQVQKDGVADSTVISSMPCLLMELRRDSSESQLASTESDKPTTGRVYESDSSNHCMLSPSSSGHLADSDTLSSAEENEPSQAETAVEGDPSGVSGATVGRKSRRSRSESETSTMAAKKNRQSSDKQNGRVAKVKGHRSQKHKERIRLLRQKREAAARKKYNLLQDSSTSDSDLTCDSSTSSSDDDEEVSGSSKTITAEIPGHLDPGFLASDKTSAGNAPLNEEINIASSDSEVEIVGVQEHARCD

SEQ ID NO: 842414 - protein, 115 aa, Homo sapiens
YLCKKNEKACSKENMEGVAEYPFKKKITGAIHGLNQTSQQKPGIEMGLYQQRHCQFELKRTEKDAENEGKLLDFLDSVSKYVLQWSLPYPWGIHSKTPSRCLKPQIGRALGLLCF

SEQ ID NO: 842415 - protein, 1563 aa, Homo sapiens
GQTGPASTKMSATSWFLVSSSGARHRLPRELIFVGREECELMLQSRSVDKQHAVINYDQDRDEHWVKDLGSLNGTFVNDMRIPDQKYVTLKLNDVIRFGYDSNMYVLERVQHRVPEEALKHEKYTSQLQVSVKGLAPKRSEALPEHTPYCEASNPRPEKGDRRPGTEAASYRTPLYGQPSWWGEDDGSTLPDAQRQGEPYPERPKGPVQQDGELHGFRAPAEPQGCSFRREPSYFEIPTKETPQPSQPPEVPAHEMPTKDAEAGGGGAAPVVQSHASFTIEFDDCSPGKMKIKDHITKFSLRQRRPPGKEATPGEMVSAETKVADWLVQNDPSLLHRVGPGDDRHSTKSDLPVHTRTLKGHKHEDGTQSDSEDPLAKAASAAGVPLEASGEQVRLQRQIKRDPQELLHNQQAFVIEFFDEDTPRKKRSQSFTHSPSGDPKADKRRGPTPADRDRPSVPAPVQAGGRSSGPQRAGSLKREKTEERLGSPSPASRTPARPFGSVGRRSRLAQDFMAQCLRESSPAARPSPEKVPPVLPAPLTPHGTSPVGPPTPPPAPTDPQLTKARKQEEDDSLSDAGTYTIETEAQDTEVEEARKMIDQVFGVLESPELSRASSATFRPVIRGDRDESDDGGVAQRMALLQEFASRPLGAAPQAEHQGLPVPGSPGGQKWVSRWASLADSYSDPGLTEDGLGRRGGEPEGSLPVRMRRRLPQLPSERADSPAGPESSRRSGPGPPELDSEQPSRLFGQEELDPDSLSDASGSDGGRGPEPGVEPQDSRRRSPQEGPTWSRGRRSPRAPGEPTPASFFIGDQNGDAVLSRKPLAAPGDGEGLGQTAQPSPPARDGVYVSANGRMVIQLRPGRSPEPDGPAPAFLRQESFTKEPASGPPAPGKPPHISSHPLLQDLAATRAARMDFHSQDTHLILKETETALAALEARLLSNSVDAECEGGSTPRPPEDALSGDSDVDTASTVSLRSGKSGPSPTTPQPLRAQKEMSPSPPAAQDPGGTALVSAREQSSERQHHPLGPTDMGRGEPVRRSAIRRGHRPRGSLDWPSEERGPVLAHLPSSDVMASNHETPEATGAGRLGSRRKPAAPPPSPAAREEQSRSSASSQKGPQALTRSNSLSTPRPTRASRLRRARLGDASDTEAADGERGSLGNPEPVGRPAAEQAKKLSRLDILAMPRKRAGSFTGTSDPEAAPARTSFSGRSVELCCASRKPTMAEARAVSRKAANTATTTGPRQPFSRARSGSARYTSTTQTPRAGSSSRARSRAPGPRDTDDDEEEPDPYGFIVQTAEIAEIARLSQTLVKDVAILAQEIHDVAGDGDTLGSSEPAHSASLSNMPSTPASTISAREELVQRIPEASLNFQKVPPGSLNSRDFDQNMNDSCEDALANKTRPRNREEVIFDNLMLNPVSQLSQAIRENTEHLAEKMKILFQNTGRAWEDLEARINAENEVPILKTSNKEISSILKELRRVQKQLEVINAIVDPSGSLDLLTGNRSLASSAQPGLGKGRVAAQSPPSPASAEALLPALPLRNFPQRASCGPPSLPDPTFLPDAERFLI

SEQ ID NO: 842416 - protein, 1598 aa, Homo sapiens
GQTGPASTKMSATSWFLVSSSGARHRLPRELIFVGREECELMLQSRSVDKQHAVINYDQDRDEHWVKDLGSLNGTFVNDMRIPDQKYVTLKLNDVIRFGYDSNMYVLERVQHRVPEEALKHEKYTSQLQVSVKGLAPKRSEALPEHTPYCEASNPRPEKGDRRPGTEAASYRTPLYGQPSWWGEDDGSTLPDAQRQGEPYPERPKGPVQQDGELHGFRAPAEPQGCSFRREPSYFEIPTKETPQPSQPPEVPAHEMPTKDAEAGGGGAAPVVQSHASFTIEFDDCSPGKMKIKDHITKFSLRQRRPPGKEATPGEMVSAETKVADWLVQNDPSLLHRVGPGDDRHSTKSDLPVHTRTLKGHKHEDGTQSDSEDPLAKAASAAGVPLEASGEQVRLQRQIKRDPQELLHNQQAFVIEFFDEDTPRKKRSQSFTHSPSGDPKADKRRGPTPADRDRPSVPAPVQAGGRSSGPQRAGSLKREKTEERLGSPSPASRTPARPFGSVGRRSRLAQDFMAQCLRESSPAARPSPEKVPPVLPAPLTPHGTSPVGPPTPPPAPTDPQLTKARKQEEDDSLSDAGTYTIETEAQDTEVEEARKMIDQVFGVLESPELSRASSATFRPVIRGDRDESDDGGVAQRMALLQEFASRPLGAAPQAEHQGLPVPGSPGGQKWVSRWASLADSYSDPGLTEDGLGRRGGEPEGSLPVRMRRRLPQLPSERADSPAGPESSRRSGPGPPELDSEQPSRLFGQEELDPDSLSDASGSDGGRGPEPGVEPQDSRRRSPQEGPTWSRGRRSPRAPGEPTPASFFIGDQNGDAVLSRKPLAAPGDGEGLGQTAQPSPPARDGVYVSANGRMVIQLRPGRSPEPDGPAPAFLRQESFTKEPASGPPAPGKPPHISSHPLLQDLAATRAARMDFHSQDTHLILKETETALAALEARLLSNSVDAECEGGSTPRPPEDALSGDSDVDTASTVSLRSGKSGPSPTTPQPLRAQKEMSPSPPAAQDPGGTALVSAREQSSERQHHPLGPTDMGRGEPVRRSAIRRGHRPRGSLDWPSEERGPVLAHLPSSDVMASNHETPEATGAGRLGSRRKPAAPPPSPAAREEQSRSSASSQKGPQALTRSNSLSTPRPTRASRLRRARLGDASDTEAADGERGSLGNPEPVGRPAAEQAKKLSRLDILAMPRKRAGSFTGTSDPEAAPARTSFSGRSVELCCASRKPTMAEARAVSRKAANTATTTGPRQPFSRARSGSARYTSNTRRRQQGSDYTSTSEEEYGSRHGSPKHTRSHTSTATQTPRAGSSSRARSRAPGPRDTDDDEEEPDPYGFIVQTAEIAEIARLSQTLVKDVAILAQEIHDVAGDGDTLGSSEPAHSASLSNMPSTPASTISAREELVQRIPEASLNFQKVPPGSLNSRDFDQNMNDSCEDALANKTRPRNREEVIFDNLMLNPVSQLSQAIRENTEHLAEKMKILFQNTGRAWEDLEARINAENEVPILKTSNKEISSILKELRRVQKQLEVINAIVDPSGSLDLLTGNRSLASSAQPGLGKGRVAAQSPPSPASAEALLPALPLRNFPQRASCGPPSLPDPTFLPDAERFLI

SEQ ID NO: 842417 - protein, 397 aa, Homo sapiens
AVDVSMKGYWVGAPASTLPSPAALSPLPEGPWDCHRVLSAALFCSCFYNQFTHQDTRRRQQGSDYTSTSEEEYGSRHGSPKHTRSHTSTATQTPRAGSSSRARSRAPGPRDTDDDEEEPDPYGFIVQTAEIAEIARLSQTLVKDVAILAQEIHDVAGDGDTLGSSEPAHSASLSNMPSTPASTISAREELVQRIPEASLNFQKVPPGSLNSRDFDQNMNDSCEDALANKTRPRNREEVIFDNLMLNPVSQLSQAIRENTEHLAEKMKILFQNTGRAWEDLEARINAENEVPILKTSNKEISSILKELRRVQKQLEVINAIVDPSGSLDLLTGNRSLASSAQPGLGKGRVAAQSPPSPASAEALLPALPLRNFPQRASCGPPSLPDPTFLPDAERFLI

SEQ ID NO: 842418 - protein, 1598 aa, Homo sapiens; identical to SEQ ID NO: 842416

SEQ ID NO: 842419 - protein, 458 aa, Homo sapiens
GQTGPASTKMSATSWFLVSSSGARHRLPRELIFVGREECELMLQSRSVDKQHAVINYDQDRDEHWVKDLGSLNGTFVNDMRIPDQKYVTLKLNDVIRFGYDSNMYVLERVQHRVPEEALKHEKYTSQLQVSVKGLAPKRSEALPEHTPYCEASNPRPEKGDRRPGTEAASYRTPLYGQPSWWGEDDGSTLPDAQRQGEPYPERPKGPVQQDGELHGFRAPAEPQGCSFRREPSYFEIPTKETPQPSQPPEVPAHEMPTKDAEAGGGGAAPVVQSHASFTIEFDDCSPGKMKIKDHITKFSLRQRRPPGKEATPGEMVSAETKVADWLVQNDPSLLHRVGPGDDRHSTKSDLPVHTRTLKGHKHEDGTQSDSEDPLAKAASAAGVPLEASGEQVRLQRQIKRDPQELLHNQQAFVIEFFDEDTPRKKRSQSFTVHSFSGGLVAVFRKMVILYDLSWNLF

SEQ ID NO: 842420 - protein, 209 aa, Homo sapiens
EWEHREVRTLAESCVCSCGAGPGVGEGSLRQAPSPPAWLPPPDLGREQRVPDDQRAPSTPTAQRGASLGRAVMRGGLGQQQRVGDVALASWRILLWRQGGHSSVVRGLGATAGVVLGQGMEQGCLCLLGVTSSPGAPEGWLCVSPVPQRGQAACRHQLRPGQGRALGEGPGQPQWGKCERPWPGLLTARPFSPGPSLSVLAPPPVIAPP

SEQ ID NO: 842421 - protein, 1664 aa, Homo sapiens
EWEHREVRTLAESCVCSCGAGPGVGEGSLRQAPSPPAWLPPPDLGREQRVPDDQRAPSTPTAQRGASLGRAVMRGGLGQQQRVGDVALASWRILLWRQGGHSSVVRGLGATAGVVLGQGMEQGCLCLLGVTSSPGAPEGCCVSLQSRSVDKQHAVINYDQDRDEHWVKDLGSLNGTFVNDMRIPDQKYVTLKLNDVIRFGYDSNMYVLERVQHRVPEEALKHEKYTSQLQVSVKGLAPKRSEALPEHTPYCEASNPRPEKGDRRPGTEAASYRTPLYGQPSWWGEDDGSTLPDAQRQGEPYPERPKGPVQQDGELHGFRAPAEPQGCSFRREPSYFEIPTKETPQPSQPPEVPAHEMPTKDAEAGGGGAAPVVQSHASFTIEFDDCSPGKMKIKDHITKFSLRQRRPPGKEATPGEMVSAETKVADWLVQNDPSLLHRVGPGDDRHSTKSDLPVHTRTLKGHKHEDGTQSDSEDPLAKAASAAGVPLEASGEQVRLQRQIKRDPQELLHNQQAFVIEFFDEDTPRKKRSQSFTHSPSGDPKADKRRGPTPADRDRPSVPAPVQAGGRSSGPQRAGSLKREKTEERLGSPSPASRTPARPFGSVGRRSRLAQDFMAQCLRESSPAARPSPEKVPPVLPAPLTPHGTSPVGPPTPPPAPTDPQLTKARKQEEDDSLSDAGTYTIETEAQDTEVEEARKMIDQVFGVLESPELSRASSATFRPVIRGDRDESDDGGVAQRMALLQEFASRPLGAAPQAEHQGLPVPGSPGGQKWVSRWASLADSYSDPGLTEDGLGRRGGEPEGSLPVRMRRRLPQLPSERADSPAGPESSRRSGPGPPELDSEQPSRLFGQEELDPDSLSDASGSDGGRGPEPGVEPQDSRRRSPQEGPTWSRGRRSPRAPGEPTPASFFIGDQNGDAVLSRKPLAAPGDGEGLGQTAQPSPPARDGVYVSANGRMVIQLRPGRSPEPDGPAPAFLRQESFTKEPASGPPAPGKPPHISSHPLLQDLAATRAARMDFHSQDTHLILKETETALAALEARLLSNSVDAECEGGSTPRPPEDALSGDSDVDTASTVSLRSGKSGPSPTTPQPLRAQKEMSPSPPAAQDPGGTALVSAREQSSERQHHPLGPTDMGRGEPVRRSAIRRGHRPRGSLDWPSEERGPVLAHLPSSDVMASNHETPEATGAGRLGSRRKPAAPPPSPAAREEQSRSSASSQKGPQALTRSNSLSTPRPTRASRLRRARLGDASDTEAADGERGSLGNPEPVGRPAAEQAKKLSRLDILAMPRKRAGSFTGTSDPEAAPARTSFSGRSVELCCASRKPTMAEARAVSRKAANTATTTGPRQPFSRARSGSARYTSTTQTPRAGSSSRARSRAPGPRDTDDDEEEPDPYGFIVQTAEIAEIARLSQTLVKDVAILAQEIHDVAGDGDTLGSSEPAHSASLSNMPSTPASTISAREELVQRIPEASLNFQKVPPGSLNSRDFDQNMNDSCEDALANKTRPRNREEVIFDNLMLNPVSQLSQAIRENTEHLAEKMKILFQNTGRAWEDLEARINAENEVPILKTSNKEISSILKELRRVQKQLEVINAIVDPSGSLDLLTGNRSLASSAQPGLGKGRVAAQSPPSPASAEALLPALPLRNFPQRASCGPPSLPDPTFLPDAERFLI

SEQ ID NO: 842422 - protein, 1526 aa, Homo sapiens
PVRMRRRLPQLPSERADSPAGPESSRRSGPGPPELDSEQHRVPEEALKHEKYTSQLQVSVKGLAPKRSEALPEHTPYCEASNPRPEKGDRRPGTEAASYRTPLYGQPSWWGEDDGSTLPDAQRQGEPYPERPKGPVQQDGELHGFRAPAEPQGCSFRREPSYFEIPTKETPQPSQPPEVPAHEMPTKDAEAGGGGAAPVVQSHASFTIEFDDCSPGKMKIKDHITKFSLRQRRPPGKEATPGEMVSAETKVADWLVQNDPSLLHRVGPGDDRHSTKSDLPVHTRTLKGHKHEDGTQSDSEDPLAKAASAAGVPLEASGEQVRLQRQIKRDPQELLHNQQAFVIEFFDEDTPRKKRSQSFTHSPSGDPKADKRRGPTPADRDRPSVPAPVQAGGRSSGPQRAGSLKREKTEERLGSPSPASRTPARPFGSVGRRSRLAQDFMAQCLRESSPAARPSPEKVPPVLPAPLTPHGTSPVGPPTPPPAPTDPQLTKARKQEEDDSLSDAGTYTIETEAQDTEVEEARKMIDQVFGVLESPELSRASSATFRPVIRGDRDESDDGGVAQRMALLQEFASRPLGAAPQAEHQGLPVPGSPGGQKWVSRWASLADSYSDPGLTEDGLGRRGGEPEGSLPVRMRRRLPQLPSERADSPAGPESSRRSGPGPPELDSEQPSRLFGQEELDPDSLSDASGSDGGRGPEPGVEPQDSRRRSPQEGPTWSRGRRSPRAPGEPTPASFFIGDQNGDAVLSRKPLAAPGDGEGLGQTAQPSPPARDGVYVSANGRMVIQLRPGRSPEPDGPAPAFLRQESFTKEPASGPPAPGKPPHISSHPLLQDLAATRAARMDFHSQDTHLILKETETALAALEARLLSNSVDAECEGGSTPRPPEDALSGDSDVDTASTVSLRSGKSGPSPTTPQPLRAQKEMSPSPPAAQDPGGTALVSAREQSSERQHHPLGPTDMGRGEPVRRSAIRRGHRPRGSLDWPSEERGPVLAHLPSSDVMASNHETPEATGAGRLGSRRKPAAPPPSPAAREEQSRSSASSQKGPQALTRSNSLSTPRPTRASRLRRARLGDASDTEAADGERGSLGNPEPVGRPAAEQAKKLSRLDILAMPRKRAGSFTGTSDPEAAPARTSFSGRSVELCCASRKPTMAEARAVSRKAANTATTTGPRQPFSRARSGSARYTSNTRRRQQGSDYTSTSEEEYGSRHGSPKHTRSHTSTATQTPRAGSSSRARSRAPGPRDTDDDEEEPDPYGFIVQTAEIAEIARLSQTLVKDVAILAQEIHDVAGDGDTLGSSEPAHSASLSNMPSTPASTISAREELVQRIPEASLNFQKVPPGSLNSRDFDQNMNDSCEDALANKTRPRNREEVIFDNLMLNPVSQLSQAIRENTEHLAEKMKILFQNTGRAWEDLEARINAENEVPILKTSNKEISSILKELRRVQKQLEVINAIVDPSGSLDLLTGNRSLASSAQPGLGKGRVAAQSPPSPASAEALLPALPLRNFPQRASCGPPSLPDPTFLPDAERFLI

SEQ ID NO: 842423 - protein, 1598 aa, Homo sapiens; identical to SEQ ID NO: 842416

SEQ ID NO: 842424 - protein, 77 aa, Homo sapiens
WGPRCRPSLLQLVQRIPEASLNFQKVPPGSLNSRDFDQNMNDSCEDALANKTRPRNREEARCPLPPRSWVWGEQGRG

SEQ ID NO: 842425 - protein, 546 aa, Homo sapiens
GEWFSSRKIAAPVPLWAQPVRGRGCGREKEPAGYLGPRQPLSPASFALSSARLLPAAARALKVVKRPPGRIMVTPCPTSPSSPAARAGRRDNDQNLRAPVKKSRRPRLRRKQPLHPLNPCPLPGDSGICDLFESPSSGSDGAESPSAARGGSPLPGPAQPVAQLDLQTFRDYGQSCYAFRKAQESHFHPREALARQPQGGAGRASSTPPLFLSSQALSSPAGSALRAPGPATAQVPPRVEAQGAVEGRHRPHFTDGEKWGVDGLRDLPRPKLATGARERGIRFRVESGLLPNSGKLFNTPELLSSSAKWNPSPSFELLSPLREVTAESRCKLLSWLIPVHRQFGLSFESLCLTVNTLDRFLTTTPVAADCFQLLGVTSLLIACKQVEVHPPRVKQLLALCCGAFSRQQLCNLECIVLHKLHFTLGAPTISFFLEHFTHARVEAGQAEASEALEAQALARGVAELSLADYAFTSYSPSLLAICCLALADRMLRVSRPVDLRLGDHPEAALEDCMGKLQLLVAINSTSLTHMLPVQICEKCSLPPSSK

SEQ ID NO: 842426 - protein, 398 aa, Homo sapiens
GEWFSSRKIAAPVPLWAQPVRGRGCGREKEPAGYLGPRQPLSPASFALSSARLLPAAARALKVVKRPPGRIMVTPCPTSPSSPAARAGRRDNDQNLRAPVKKSRRPRLRRKQPLHPLNPCPLPGDSGICDLFESPSSGSDGAESPSAARGGSPLPGPAQPVAQLDLQTFRDYGQSCYAFRKAQESHFHPREALARQPQVTAESRCKLLSWLIPVHRQFGLSFESLCLTVNTLDRFLTTTPVAADCFQLLGVTSLLIACKQVEVHPPRVKQLLALCCGAFSRQQLCNLECIVLHKLHFTLGAPTISFFLEHFTHARVEAGQAEASEALEAQALARGVAELSLADYAFTSYSPSLLAICCLALADRMLRVSRPVDLRLGDHPEAALEDCMVPGPAAGPLP

SEQ ID NO: 842427 - protein, 421 aa, Homo sapiens
GEWFSSRKIAAPVPLWAQPVRGRGCGREKEPAGYLGPRQPLSPASFALSSARLLPAAARALKVVKRPPGRIMVTPCPTSPSSPAARAGRRDNDQNLRAPVKKSRRPRLRRKQPLHPLNPCPLPGDSGICDLFESPSSGSDGAESPSAARGGSPLPGPAQPVAQLDLQTFRDYGQSCYAFRKAQESHFHPREALARQPQVTAESRCKLLSWLIPVHRQFGLSFESLCLTVNTLDRFLTTTPVAADCFQLLGVTSLLIACKQVEVHPPRVKQLLALCCGAFSRQQLCNLECIVLHKLHFTLGAPTISFFLEHFTHARVEAGQAEASEALEAQALARGVAELSLADYAFTSYSPSLLAICCLALADRMLRVSRPVDLRLGDHPEAALEDCMGKLQLLVAINSTSLTHMLPVQICEKCSLPPSSK

SEQ ID NO: 842428 - protein, 202 aa, Homo sapiens
GEWFSSRKIAAPVPLWAQPVRGRGCGREKEPAGYLGPRQPLSPASFALSSARLLPAAARALKVVKRPPGRIMVTPCPTSPSSPAARAGRRDNDQNLRAPVKKSRRPRLRRKQPLHPLNPCPLPGDSGICDLFESPSSGSDGAESPSAARGGSPLPGPAQPVAQLDLQTFRDYGQSCYAFRKAQESHFHPREALARQPQVRCW

SEQ ID NO: 842429 - protein, 202 aa, Homo sapiens; identical to SEQ ID NO: 842428

SEQ ID NO: 842430 - protein, 911 aa, Homo sapiens
MAAAAASAPQQLSDEELFSQLRRYGLSPGPVTESTRPVYLKKLKKLREEEQQQHRSGGRGNKTRNSNNNNTAAATVAAAGPAAAAAAGMGVRPVSGDLSYLRTPGGLCRISASGPESLLGGPGGASAAPAAGSKVLLGFSSDESDVEASPRDQAGGGGRKDRASLQYRGLKAPPAPLAASEVTNSNSAERRKPHSWWGARRPAGPELQTPPGKDGAVEDEEGEGEDGEERDPETEEPLWASRTVNGSRLVPYSCRENYSDSEEEDDDDVASSRQVLKDDSLSRHRPRRTHSKPLPPLTAKSAGGRLETSVQGGGGLAMNDRAAAAGSLDRSRNLEEAAAAEQGGGCDQVDSSPVPRYRVNAKKLTPLLPPPLTDMDSTLDSSTGSLLKTNNHIGGGAFSVDSPRIYSNSLPPSAAVAASSSLRINHANHTGSNHTYLKNTYNKPKLSEPEEELLQQFKREEVSPTGSFSAHYLSMFLLTAACLFFLILGLTYLGMRGTGVSEDGELSIENPFGETFGKIQESEKTLMMNTLYKLHDRLAQLAGDHECGSSSQRTLSVQEAAAYLKDLGPEYEGIFNTSLQWILENGKDVGIRCVGFGPEEELTNITDVQFLQSTRPLMSFWCRFRRAFVTVTHRLLLLCLGVVMVCVVLRYMKYRWTKEEEETRQMYDMVVKIIDVLRSHNEACQENKDLQPYMPIPHVRDSLIQPHDRKKMKKVWDRAVDFLAANESRVRTETRRIGGADFLVWRWIQPSASCDKILVIPSKVWQGQAFHLDRRNSPPNSLTPCLKIRNMFDPVMEIGDQWHLAIQEAILEKCSDNDGIVHIAVDKNSREGCVYVKCLSPEYAGKAFKALHGSWFDGKLVTVKYLRLDRYHHRFPQALTSNTPLKPSNKHMNSMSHLRLRTGLTNSQGSS

SEQ ID NO: 842431 - protein, 911 aa, Homo sapiens; identical to SEQ ID NO: 842430

SEQ ID NO: 842432 - protein, 911 aa, Homo sapiens; identical to SEQ ID NO: 842430

SEQ ID NO: 842433 - protein, 911 aa, Homo sapiens; identical to SEQ ID NO: 842430

SEQ ID NO: 842434 - protein, 911 aa, Homo sapiens; identical to SEQ ID NO: 842430

SEQ ID NO: 842435 - protein, 504 aa, Homo sapiens
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVGLHSASIPGILALDLCPSDTNKILTGGADKNVVVFDKSSEQILATLKGHTKKVTSVVFHPSQDLVFSASPDATIRIWSVPNASCVQVVRAHESAVTGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 842436 - protein, 114 aa, Homo sapiens
MSLICSISNEVPEHPCVSPVSNHVYERRLIEKYIAENGTDPINNQPLSEEQLIDIKVAHPIRPKPPSATSIPAILKALQDEWDAVMLQQLSLLAQAACRTNPRKFPKTSVVGAG

SEQ ID NO: 842437 - protein, 504 aa, Homo sapiens; identical to SEQ ID NO: 842435

SEQ ID NO: 842438 - protein, 504 aa, Homo sapiens; identical to SEQ ID NO: 842435

SEQ ID NO: 842439 - protein, 244 aa, Homo sapiens
DLEDPVSSPFVVFTFQDLVFSASPDATIRIWSVPNASCVQVVRAHESAVTGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 842440 - protein, 205 aa, Homo sapiens
MLAQTPELDRGGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 842441 - protein, 156 aa, Homo sapiens
WSLTCCEIAYPDSLFYVDLAAKDSQIKICDLMERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 842442 - protein, 221 aa, Homo sapiens
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVEGLCRVL

SEQ ID NO: 842443 - protein, 109 aa, Homo sapiens
MYFSMMPPLINMIRDRGYTSLLRHRWDIHIISLWSEWWPENHGGMDHPHPCNSRPHGNGCGRKNCHPLKAQGRSPGPLPSCRSMDVVVAVPHPFCCSSCETGEAEPREL

SEQ ID NO: 842444 - protein, 220 aa, Homo sapiens
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREALATLKPQAGLIVPQAVPSSQPSVVGAGEPMDLGELVGMTPEIIQKLQDKDTVLTLERQEEDGKTVPEELVSRNSQNGGAPVGASAHPDRL

SEQ ID NO: 842445 - protein, 447 aa, Homo sapiens
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVGLHSASIPGILALDLCPSDTNKILTGGADKNVVVFDKSSEQILATLKGHTKKVTSVVFHPSQDLVFSASPDATIRIWSVPNASCVQVVRAHESAVTGLSLHATGDYLLSSSDDQYWAFSDIQTGRVLTKVTDETSGCSLTCAQFHPDGLIFGTGTMDSQIKIWDLKVKSLIFDQSGTYLALGGTDVQIYICKQWTEILHFTEHSGLTTGVAFGHHAKFIASTGMDRSLKFYSL

SEQ ID NO: 842446 - protein, 495 aa, Homo sapiens [sequence omitted]

SEQ ID NO: 842447 - protein, 125 aa, Homo sapiens
MERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 842448 - protein, 127 aa, Homo sapiens
LVMGTEWPGKLATLVRSFKSQIFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 842449 - protein, 229 aa, Homo sapiens
VLSPCSWSLFLVCLAPFCSSIRLLWCVAFYGWCLCLSLFVLFLMSFGVLLFPTWLLSVPVGPFDLLLLLNYLSVGLFLAPSSLFLPLVYVGLFLVCSSSCFFPSPCVSLRVYVFFISLVWVFPFLCYVLFDVLLSRYCRFLCTFVFCFVSLVSFCYARLLSPCCWISLFGHLYGALMSLVSGVPTYCLVILCNPQRCDAILSRYFPELFCALTSVLMALSSLSSCAPVR

SEQ ID NO: 842450 - protein, 110 aa, Homo sapiens [sequence omitted]

SEQ ID NO: 842451 - protein, 111 aa, Homo sapiens
MHKDRHTRPCPPSSSLLASVVFKGASVRTVCCAVPPPPACVSSNAVLPSRQLCGGSCLDHLKADGWAWIRCCPPGSEEAALLLGPGHRLRQMDCLSQHPRTGTPYHRGSSG

SEQ ID NO: 842452 - protein, 246 aa, Homo sapiens
MCFPLISLILFLFGTCTAYWSGLLSSASVRLLSSLWLALKRPSELPKDIKMISPDLPFLTIVLIIVSWTTCGALAILLSYLYYVFKVVHLQASLTTFKNSQPVNPKHSRRSEKKSNHHKDSSIHHLRLSANDAEDSLRMHSTVINLLTWIVLLSMPSLIYWLKNLRYYFKLNPDPCKPLAFILIPTMAILGNTYTVSIKSSKLLKTTSQFPLPLAVGVIAFGSAHLYRLPCFVFIPLLLHALCNFM

SEQ ID NO: 842453 - protein, 178 aa, Homo sapiens
MCFPLISLILFLFGTCTAYWSGLLSSASVRLLSSLWLALKRPSELPKDIKMISPDLPFLTIVLIIVSWTTCGALAILLSYLYYVFKVVHLQASLTTFKNSQPVNPKHSRRSEKKSNHHKDSSIHHLRLSANDAEDSLRMHSTVINLLTWIVLLSMPSLIYWLKNLRYYFKLILLVRHI

SEQ ID NO: 842454 - protein, 585 aa, Homo sapiens
KVVTEPPVVTLLDKKEGEQAKALFEKVKKFRMHVEEGDILYTMYIRQTVLKVCKFLAILVYNLVYVEKISFLVACRVETSEVTGYASFCCNHTKAHLFSKLAFCYISFVCIYGLTCIYTLYWLFHRPLKEYSFRSVREETGMGDIPDVKNDFAFMLHLIDQYDSLYSKRFAVFLSEVSESRLKQLNLNHEWTPEKLRQKLQRNAAGRLELALCMLPGLPDTVFELSEVESLRLEAICDITFPPGLSQLVHLQELSLLHSPARLPFSLQVFLRDHLKVMRVKCEELREVPLWVFGLRGLEELHLEGLFPQELARAATLESLRELKQLKVLSLRSNAGKVPASVTDVAGHLQRLSLHNDGARLVALNSLKKLAALRELELVACGLERIPHAVFSLGALQELDLKDNHLRSIEEILSFQHCRKLVTLRLWHNQIAYVPEHVRKLRSLEQLYLSYNKLETLPSQLGLCSGLRLLDVSHNGLHSLPPEVGLLQNLQHLALSYNALEALPEELFFCRKLRTLLLGDNQLSQLSPHVGALRALSRLELKGNRLEALPEELGNCGGLKKAGLLVEDTLYQGLPAEVRDKMEEE

SEQ ID NO: 842455 - protein, 88 aa, Homo sapiens
GTARKHPKGGRPPILPAGGGLLASVGTARVHVLRGMTCRNGSLCTRFQDCPPACNSPSAAKTFLDQYPSSGSSREAFARGFTLLNSKP

SEQ ID NO: 842456 - protein, 307 aa, Homo sapiens
MEADKDDTQQILKEHSPDEFIKDEQNKGLIDEITKKNIQLKKEIQKLETELQEATKEFQIKEDIPETKMKFLSVETPENDSQLSNISCSFQVSSKVPYEIQKGQALITFEKEEVAQNVVSMSKHHVQIKDVNLEVTAKPVPLNSGVRFQVYVEVSKMKINVTEIPDTLREDQMRDKLELSFSKSRNGGGEVDRVDYDRQSGSAVITFVEIGVADKILKKKEYPLYINQTCHRVTVSPYTEIHLKKYQIFSGTSKRTVLLTGMEGIQMDEEIVEDLINIHFQRAKNGGGEVDVVKCSLGQPHIAYFEE

SEQ ID NO: 842457 - protein, 307 aa, Homo sapiens; identical to SEQ ID NO: 842456

SEQ ID NO: 842458 - protein, 147 aa, Homo sapiens
AWRASVPVAPCPGTAACTSWAALSRNGGGEVDRVDYDRQSGSAVITFVEIGVADKILKKKEYPLYINQTCHRVTVSPYTEIHLKKYQIFSGTSKRTVLLTGMEGIQMDEEIVEDLINIHFQRAKNGGGEVDVVKCSLGQPHIAYFEE

SEQ ID NO: 842459 - protein, 39 aa, Homo sapiens
LPNKDRLCPSQELSLNVGLILALHSISMALRPFSLTSFI

SEQ ID NO: 842460 - protein, 113 aa, Homo sapiens
FYINTDNVKQSLSKKRKALATSVLDILAKNLHKEVDSSSATQGAHQEHPSWKAPQDVVVEGTVTCREMLETKEEEQVREGKGAACCPPQRLLPLPDLEEFRSISRKIYEKPNS

SEQ ID NO: 842461 - protein, 587 aa, Homo sapiens
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILVVCGYITVSDRSSGIHKIQDDPQSSKFLHLNNLNSFKSTECLLLSLLHREKNKEESDSTERLQISNPGFQERCAKKMQLVNLRNRRVSANDIMGGSCHNLIGLSNMHDLSSNSKPRCCSLEGIVDVPGNSSKEASSVFHQSFPNIEGQNNKLFLESKPKQEFLLNLHSEENIQKPFSAGFKRTSTLTVQDQEELCNGKCKSKQLCRSQSLLLRSSTRRNSYINTPVAEIIMKPNVGQGSTSVQTAMESELGESSATINKRLCKSTIELSENSLLPASSMLTGTQ

SEQ ID NO: 842462 - protein, 615 aa, Homo sapiens
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILVVCGYITVSDRSSGIHKIQDDPQSSKFLHLNNLNSFKSTECLLLSLLHREKNKEESDSTERLQISNPGFQERCAKKMQLVNLRNRRVSANDIMGGSCHNLIGLSNMHDLSSNSKPRCCSLEGIVDVPGNSSKEASSVFHQSFPNIEGQNNKLFLESKPKQEFLLNLHSEENIQKPFSAGFKRTSTLTVQDQEELCNGKCKSKQLCRSQSLLLRSSTRRNSYINTPVAEIIMKPNVGQGSTSVQTAMESELGESSATINKRLCKSTIELSENSLLPASSMLTGTQSKAVAFNACNINFECLLTLCFAYLAFLP

SEQ ID NO: 842463 - protein, 615 aa, Homo sapiens; identical to SEQ ID NO: 842462

SEQ ID NO: 842464 - protein, 615 aa, Homo sapiens; identical to SEQ ID NO: 842462

SEQ ID NO: 842465 - protein, 166 aa, Homo sapiens [sequence omitted]

SEQ ID NO: 842466 - protein, 527 aa, Homo sapiens
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILGLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 842467 - protein, 811 aa, Homo sapiens
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILVVCGYITVSDRSSGIHKIQDDPQSSKFLHLNNLNSFKSTECLLLSLLHREKNKEESDSTERLQISNPGFQERCAKKMQLVNLRNRRVSANDIMGGSCHNLIGLSNMHDLSSNSKPRCCSLEGIVDVPGNSSKEASSVFHQSFPNIEGQNNKLFLESKPKQEFLLNLHSEENIQKPFSAGFKRTSTLTVQDQEELCNGKCKSKQLCRSQSLLLRSSTRRNSYINTPVAEIIMKPNVGQGSTSVQTAMESELGESSATINKRLCKSTIELSENSLLPASSMLTGTQSLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 842468 - protein, 394 aa, Homo sapiens
MYNMANTSKRGVVILQNKSDDLPHWVLSAMKCLANWPRSNDMNNPTYVGFERDVFRTIADYFLDLPEPLLTFEYYELFVNILVVCGYITVSDRSSGIHKIQDDPQSSKFLHLNNLNSFKSTECLLLSLLHREKNKEESDSTERLQISNPGFQERCAKKMQLVNLRNRRVSANDIMGGSCHNLIGLSNMHDLSSNSKPRCCSLEGIVDVPGNSSKEASSVFHQSFPNIEGQNNKLFLESKPKQEFLLNLHSEENIQKPFSAGFKRTSTLTVQDQEELCNGKCKSKQLCRSQSLLLRSSTRRNSYINTPVAEIIMKPNVGQGSTSVQTAMESELGESSATINKRLCKSTIELSENSLLPASSMLTGTQSKAVAFNACNINFECLLTLCFAYLAFLP

SEQ ID NO: 842469 - protein, 475 aa, Homo sapiens
MSPEVTCPRRGHLPRFHPRTWVEPVVASSQVAASLYDAGLLLVVKASYGTGGSSNHSASPSPRGALEDQQQRAISNFYIIYNLVVGLSPLLSAYGLGWLSDRYHRKISICMSLLGFLLSRLGLLLKVLLDWPVEVLYGAAALNGLFGGFSAFWSGVMALGSLGSSEGRRSVRLILIDLMLGLAGFCGSMASGHLFKQMAGHSGQGLILTACSVSCASFALLYSLLVLKVPESVAKPSQELPAVDTVSGTVGTYRTLDPDQLDQQYAVGHPPSPGKAKPHKTTIALLFVGAIIYDLAVVGTVDVIPLFVLREPLGWNQVQVGYGMAAGYTIFITSFLGVLVFSRCFRDTTMIMIGMVSFGSGALLLAFVKETYMFYIARAVMLFALIPVTTIRSAMSKLIKGSSYGKVFVILQLSLALTGVVTSTLYNKIYQLTMDMFVGSCFALSSFLSFLAIIPISIVAYKQVPLSPYGDIIEK

SEQ ID NO: 842470 - protein, 475 aa, Homo sapiens; identical to SEQ ID NO: 842469

SEQ ID NO: 842471 - protein, 109 aa, Homo sapiens
MPGAGTAEPRRLVQSGGAWSCTCRCCRAVPGGGAARRSLQRLPPSAVRQEDSLPPESQKHEIFLLFQQLATTSLLGKGQERRENSHHNISKGIHCQNLEYSTGQTFPPR

SEQ ID NO: 842472 - protein, 112 aa, Homo sapiens
ERETEREREREGCPETLSKSFTEIPIASVFSSVKIFGHDVRSTNRTDASPPHCACVPFPQQVPPHSWDQGSPPAPACIPILLVPFLPPALVLIVPFGPNSLNAQHMDSANSC

SEQ ID NO: 842473 - protein, 131 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPK

SEQ ID NO: 842474 - protein, 584 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGVALAVILCNTRHISDSVFLEAAKALTSQLTDEELAQGRLYPPLANIQEVSINIAIKVTEYLYANKMAFRYPEPEDKAKYVKERTWRSEYDSLLPDVYEWPESASSPPVITE

SEQ ID NO: 842475 - protein, 837 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGVALAVILCNTRHISDSVFLEAAKALTSQLTDEELAQGRLYPPLANIQEVSINIAIKVKEKMLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISE

SEQ ID NO: 842476 - protein, 718 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGVALAVILCNTRHISDSVFLEAAKALTSQLTDEELAQGRLYPPLANIQEVSINIAIKVKEKMLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGSVY

SEQ ID NO: 842477 - protein, 414 aa, Homo sapiens
RNRRFSLFQYGKILSKLFEGWTKNSTAVILRITVQSSRFRYRGSFNSTFQRRHSSSHDLINQENVGGNHSAGVKKLFLFSMHSSSLYLGQDSTRHHSGRLVVDANLEASGAPIHKLDGTLGLDGGNWQHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPIS

SEQ ID NO: 842478 - protein, 479 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGYRIPIC

SEQ ID NO: 842479 - protein, 584 aa, Homo sapiens; identical to SEQ ID NO: 842474

SEQ ID NO: 842480 - protein, 584 aa, Homo sapiens; identical to SEQ ID NO: 842474

SEQ ID NO: 842481 - protein, 304 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISE

SEQ ID NO: 842482 - protein, 114 aa, Homo sapiens
MLSRLRVVSTTCTLACRHLHIKEKGKPLMLNPRTNKGMAFTLQERQMLGLQGLLPPKIETQDIQALRFHRNLKKMTSPLEKILQDDIESLMPIVYTPTVGLACSQYGHIFRRPK

SEQ ID NO: 842483 - protein, 44 aa, Homo sapiens
LGFGLRSAALSSSMASVSSLSNTEGPGAGAAPSPVPGPVWNRKV

SEQ ID NO: 842484 - protein, 69 aa, Homo sapiens
HSDLRHWNPSVRVSESLLFQVSGPGQGRTLPTPHLRRLQKRESEQTRTVSSLITSTHDLERGALGQGWG

SEQ ID NO: 842485 - protein, 154 aa, Homo sapiens [sequence omitted]

SEQ ID NO: 842486 - protein, 238 aa, Homo sapiens
MLGTDRCVVEEWLSEFKALPDTQITSYAATLHRKKTLVPALYKVIQDSNNELLEPVCHQLFELYRSSEVRLKRFTLQFLPELMWVYLRLTVSRDRQSNGCIEALLLGIYNLEIADKDGNNKVLSFTIPSLSKPSIYHEPSTIGSMALTEGALCQHDLIRVVYSDLHPQRETFTAQNRFEVLSFLMLCYNSAIVYMPASSYQSLCRMGSRVCVSGFPRQHEKHWKELCGRIVLDPEFMV

SEQ ID NO: 842487 - protein, 156 aa, Homo sapiens
MWVYLRLTVSRDRQSNGCIEALLLGIYNLEIADKDGNNKVLSFTIPSLSKPSIYHEPSTIGSMALTEGALCQHDLIRVVYSDLHPQRETFTAQNRFEVLSFLMLCYNSAIVYMPASSYQSLCRMGSRVCVSGFPRQHEKHWKELCGRIVLDPEFMV

SEQ ID NO: 842488 - protein, 435 aa, Homo sapiens
MVGSDPEVGGPMRWLLSRRKGGGGGLRDGQGDGVEYVQPPGLTGEGDGGGHREFSRPPPSPRHTAESPFPFLHSTLSVPHPAPFQACPGPQQQKPHHLHPHILLAGSAAVPPRVLKAEMNNTAASPMSTATSSSGRSTGKSISFATELQSMMYSLGDARRPLHETAVLVEDVVHTQLINLLQQAAEVSQLRGARVITPEDLLFLMRKDKKKLRRLLKYMFIRDYKSKIVKGIDEDDLLEDKLSGSNNANKRQKIAQDFLNSIDQTGELLAMFEDDEIDEVKQERMERAERQTRIMDSAQYAEFCESRQLSFSKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTNAYRRNGMAFLAC

SEQ ID NO: 842489 - protein, 435 aa, Homo sapiens; identical to SEQ ID NO: 842488

SEQ ID NO: 842490 - protein, 435 aa, Homo sapiens; identical to SEQ ID NO: 842488

SEQ ID NO: 842491 - protein, 341 aa, Homo sapiens
PASLPPCSLISDCCASNQGDSVGVGPSEPGVRYNLMVRRFLSRCEKRKFRVGVTRFSRYSLGDARRPLHETAVLVEDVVHTQLINLLQQAAEVSQLRGARVITPEDLLFLMRKDKKKLRRLLKYMFIRDYKSKIVKGIDEDDLLEDKLSGSNNANKRQKIAQDFLNSIDQTGELLAMFEDDEIDEVKQERMERAERQTRIMDSAQYAEFCESRQLSFSKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTNAYRRNGMAFLAC

SEQ ID NO: 842492 - protein, 228 aa, Homo sapiens
PGALWLPLLPHAGRQEVGESQQPQASPSSHAAHSPKGRSHSTMPSARNSTNFISRQLVSRAENFPQATGFLAEKASLLTVPLRPTEPAVVIHLLQEAKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTISFSLTECLPQEWDGFSSLLM

SEQ ID NO: 842493 - protein, 435 aa, Homo sapiens; identical to SEQ ID NO: 842488

SEQ ID NO: 842494 - protein, 453 aa, Homo sapiens
MVGSDPEVGGPMRWLLSRRKGGGGGLRDGQGDGVEYVQPPGLTGEGDGGGHREFSRPPPSPRHTAESPFPFLHSTLSVPHPAPFQACPGPQQQKPHHLHPHILLAGSAAVPPRVLKAEMNNTAASPMSTATSSSGRSTGKSISFATELQSMIYHAGAQKLLDFGAFWMFRYSLGDARRPLHETAVLVEDVVHTQLINLLQQAAEVSQLRGARVITPEDLLFLMRKDKKKLRRLLKYMFIRDYKSKIVKGIDEDDLLEDKLSGSNNANKRQKIAQDFLNSIDQTGELLAMFEDDEIDEVKQERMERAERQTRIMDSAQYAEFCESRQLSFSKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTNAYRRNGMAFLAC

SEQ ID NO: 842495 - protein, 150 aa, Homo sapiens
PHFPQPHRTGVPTLSPALRRWALDSEALPFPAHSLPNDNALVSQKKKIKRERSSLGATGRSEKRTKSLCGRAVLSRRELFLGSSDPDALAQRDNVGHLRSVAHPFCAPVSNSAEQALIIRHHVSWKWMNNQGLPQRTNAPKCKVRSGSEY

SEQ ID NO: 842496 - protein, 128 aa, Homo sapiens
FIFILLLKNFWTILHYHHHHHYYYYYYYYLRWSLALSASLECSDTISAHCSLCLLGSSDLPTSGDPPSWDSQSAGITGMSHHTQPILHFLKINSKIILPSKRKSHQNFYWNWIHLKVILSGKNRCFRF

SEQ ID NO: 842497 - protein, 111 aa, Homo sapiens
NAQQDYHARSYFQSHVVPPLLRKTDQDHGGTGRDGWIVDYIHIFGQGQRYLNRRNWAGTGHSLQQVTGHDHYNADLKPIDGFNGRFGYRRNTPALRQSTSVFGEVTHFPLF

SEQ ID NO: 842498 - protein, 107 aa, Homo sapiens [sequence omitted]

SEQ ID NO: 842499 - protein, 107 aa, Homo sapiens
MTDLKQSHSVRLNDGPFMPVLGFGTYAPDHTPKSQAAEATKVAIDVGFRHIDSAYLYRQERGNILHHQALGYFLSGRIGSPGPRKVTEETWTGLCRSLHYSCTICYE

SEQ ID NO: 842500 - protein, 88 aa, Homo sapiens
ECAVVAAATTVAMNSVGEACTDMKREYDQCFNRWFAEKFLKGDSSGDPCTDLFKRYQQCVQKAIKEKEIPIEGLEFMGHGKEKPENSS

SEQ ID NO: 842501 - protein, 133 aa, Homo sapiens
MSLLFTETYLRYRMGLAPDDVPPQSLTSGLHMTEPIYINHDLTPPWFLPRSVALVRSEYSVGEACTDMKREYDQCFNRWFAEKFLKGDSSGDPCTDLFKRYQQCVQKAIKEKEIPIEGLEFMGHGKEKPENSS

SEQ ID NO: 842502 - protein, 133 aa, Homo sapiens; identical to SEQ ID NO: 842501

SEQ ID NO: 842503 - protein, 88 aa, Homo sapiens; identical to SEQ ID NO: 842500

SEQ ID NO: 842504 - protein, 144 aa, Homo sapiens
MSLLFTETYLRYRMGLAPDDVPPQSLTSGLHMTEPIYINHDLTPPWFLPRSVALVRSEYSVGEACTDMKREYDQCFNRWFAEKFLKGDSSGDPCTDLFKRYQQCVQVSPPASVPRPCILGAVSHHTHRILRGLGLDWKGGEKSQ

SEQ ID NO: 842505 - protein, 95 aa, Homo sapiens
RSGSECAEVSRLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 842506 - protein, 422 aa, Homo sapiens
VGVRVRGGESVCCGLVVLAAAVQAAGNGRWGAGGAGPASAWPAPQSARAAPAAANCPERLLRPRETSGPAPGGSLPRWPRGGGVAMATASPAADGGRGRPWEGGLVSWPPAPPLTLPWTWMGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 842507 - protein, 259 aa, Homo sapiens
MLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 842508 - protein, 414 aa, Homo sapiens
VGVRVRGGESVCCGLVVLAAAVQAAGNGRWGAGGAGPASAWPAPQSARAAPAAANCPERLLRPRETSGPAPGGSLPRWPRGGGVAMATASPAADGGRGRPWEGGLVSWPPAPPLTLPWTWMGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIGPRRLMRLPGMADLLSCSQ

SEQ ID NO: 842509 - protein, 371 aa, Homo sapiens
VGVRVRGGESVCCGLVVLAAAVQAAGNGRWGAGGAGPASAWPAPQSARAAPAAANCPERLLRPRETSGPAPGGSLPRWPRGGGVAMATASPAADGGRGRPWEGGLVSWPPAPPLTLPWTWMGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKTTARTLPTS

SEQ ID NO: 842510 - protein, 304 aa, Homo sapiens
VGVRVRGGESVCCGLVVLAAAVQAAGNGRWGAGGAGPASAWPAPQSARAAPAAANCPERLLRPRETSGPAPGGSLPRWPRGGGVAMATASPAADGGRGRPWEGGLVSWPPAPPLTLPWTWMGPSWGQHPGEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 842511 - protein, 160 aa, Homo sapiens
MEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 842512 - protein, 188 aa, Homo sapiens
NLARYEAGGVIGRGEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 842513 - protein, 222 aa, Homo sapiens [sequence omitted]

SEQ ID NO: 842514 - protein, 113 aa, Homo sapiens
MAQELLILFSTQKLHCPQGPSDSAGEAKKSESKKEKTPPENTRDHNTWDQTELAYSFAMGCWPKNGLLDMNKGLSLQHIGRPHSGIDDCKNIANIMKTLAYRGFIFKQTSKPF

SEQ ID NO: 842515 - protein, 233 aa, Homo sapiens
VGVRVRGGESVCCGLVVLAAAVQAAGNGRWGAGGAGPASAWPAPQSARAAPAAANCPERLLRPRETSGPAPGGSLPRWPRGGGVAMATASPAADGGRGRPWEGGLVSWPPAPPLTLPWTWMGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPEDESVACR

SEQ ID NO: 842516 - protein, 118 aa, Homo sapiens
KKGFRRNGQRKGLFEINVKVKFFVNLVNWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 842517 - protein, 422 aa, Homo sapiens; identical to SEQ ID NO: 842506

SEQ ID NO: 842518 - protein, 627 aa, Homo sapiens
VGVRVRGGESVCCGLVVLAAAVQAAGNGRWGAGGAGPASAWPAPQSARAAPAAANCPERLLRPRETSGPAPGGSLPRWPRGGGVAMATASPAADGGRGRPWEGGLVSWPPAPPLTLPWTWMGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIGSALACLDSAWGEGAGSFLPELTPLEPQRHLRNWFLPDTRLFFSSNHRWKNGYMDGRLQEHCQHHEDTRLSRLHLQADIEAVLIGRGQDGAGQGSCLAQPRILLSLTRGEEGEWHSSVSRVSPAALWAHALGVGLCPCKGLATWPFWSRHFVPPIPTPQSQPSISPSHCGPGLGGPRHSPPPPWYTGFCGATKPLLCPLPSIVHGVWCPQGSRTDQAPPCVYPHPRCERATE

SEQ ID NO: 842519 - protein, 450 aa, Homo sapiens
VGVRVRGGESVCCGLVVLAAAVQAAGNGRWGAGGAGPASAWPAPQSARAAPAAANCPERLLRPRETSGPAPGGSLPRWPRGGGVAMATASPAADGGRGRPWEGGLVSWPPAPPLTLPWTWMGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKGSSPGTASGTSCYQSEEAQRKENTPGVKAYSFAMGCWPKNGLLDMNKGLSLQHIGRPHSGIDDCKNIANIMKTLAYRGFIFKQTSKPF

SEQ ID NO: 842520 - protein, 477 aa, Homo sapiens
VGVRVRGGESVCCGLVVLAAAVQAAGNGRWGAGGAGPASAWPAPQSARAAPAAANCPERLLRPRETSGPAPGGSLPRWPRGGGVAMATASPAADGGRGRPWEGGLVSWPPAPPLTLPWTWMGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIGSALACLDSAWGEGAGSFLPELTPLEPQRHLRNWFLPDTRLFFSSNHRWKNGRWMDDCKNIANIMKTLAYRGFIFKQTSKPF

SEQ ID NO: 842521 - protein, 188 aa, Homo sapiens
DAWVDPRVGSECAEEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 842522 - protein, 146 aa, Homo sapiens
RSGSECAEVSRLTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 842523 - protein, 131 aa, Homo sapiens
VGVRVRGGESVCCGLVVLAAAVQAAGNGRWGAGGAGPASAWPAPQSARAAPAAANCPERLLRPRETSGPAPGGSLPRWPRGGGVAMATASPAADGGRGRPWEGGLVSWPPAPPLTLPWTWMGPSWGQHPGF

SEQ ID NO: 842524 - protein, 182 aa, Homo sapiens
VGVRVRGGESVCCGLVVLAAAVQAAGNGRWGAGGAGPASAWPAPQSARAAPAAANCPERLLRPRETSGPAPGGSLPRWPRGGGVAMATASPAADGGRGRPWEGGLVSWPPAPPLTLPWTWMGPSWGQHPGVGDAEWPRQDWALVNACGVRVAVRRIYATWGAGPCAYPGCLLNLLSNVLAEG

SEQ ID NO: 842525 - protein, 37 aa, Homo sapiens
MLATQRLLGIQWHTSGSVAGGALSSPFQASQPPGRRW

SEQ ID NO: 842526 - protein, 143 aa, Homo sapiens
ANAGSSRRGRREQEFLHMAPGEVTITVRLIRSFEHRNFKPVVYHGVNLDQTVKEFIVFLKQDVPLRTNLPPPFRNYKYDALKIIHQAHKSKTNELVLSLEDDERLLLKEDSTLKAAGIASETEIAFFCEEDYRNYKANPISSW

SEQ ID NO: 842527 - protein, 110 aa, Homo sapiens
RELGSVLARCGDGTRGKGRGRRPKNGGPYVSFLSLNLARPEEAGSCISGQVNSETWEWRAGPAPPLGSRGDPRRWSLMSSVMVESWTGLPKGEAEASSSELLGQLRGPRT

SEQ ID NO: 842528 - protein, 81 aa, Homo sapiens
ANAGSSRRGRREQEFLHMAPGEVTITVRLIRSFEHRNFKPVVYHGVNLDQTVKEFIVFLKQDKLQEQDKEFLDVLHTDSLC

SEQ ID NO: 842529 - protein, 126 aa, Homo sapiens
MLLSLWRSACQPLGMVGVKVHYSGAWSSLCPLRGPLWQTWKTLPTAAAPCSCPLTLPRAGAPQLQRHCQGVAATAAAPSILWCRRPGLYPNGLGAPVCCRKHRSLGRLERPLSQPGRHRRPLFFLK

SEQ ID NO: 842530 - protein, 550 aa, Homo sapiens
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 842531 - protein, 420 aa, Homo sapiens
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDDDAFEPVEVSLPAPGDGGSEGALLRRLEQPLPTAGASLADLEDSADSSSALLVPPDPAQSGSTPAAEALPGGGRHSRSSLNTVV

SEQ ID NO: 842532 - protein, 509 aa, Homo sapiens
MVPKADSGAFLLLFLLVLTVTEPLRPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 842533 - protein, 550 aa, Homo sapiens; identical to SEQ ID NO: 842530

SEQ ID NO: 842534 - protein, 550 aa, Homo sapiens; identical to SEQ ID NO: 842530

SEQ ID NO: 842535 - protein, 550 aa, Homo sapiens; identical to SEQ ID NO: 842530

SEQ ID NO: 842536 - protein, 406 aa, Homo sapiens
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHLTSPQILLIRQRYDGLT

SEQ ID NO: 842537 - protein, 103 aa, Homo sapiens
GGAGRRGAGRAGRPPSCAQLESVPEVAAESVRQPAAQPKLFPAASPRLAQVQPRLTLRLARSPDPQSGLVRPPSRPGDDERRINGCQVASEGPRTTQQSPPRA

SEQ ID NO: 842538 - protein, 240 aa, Homo sapiens
MVPKADSGAFLLLFLLVLTVTEPLRPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRKAGFRYVAQAGLKL

SEQ ID NO: 842539 - protein, 550 aa, Homo sapiens; identical to SEQ ID NO: 842530

SEQ ID NO: 842540 - protein, 405 aa, Homo sapiens
DDQAHPAGHGVKQTVAIWVQTHELAALFGVLAVLLAALGPLTESSHTHLRLPSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 842541 - protein, 180 aa, Homo sapiens
MLLSLWRSACQPLGMVGVKVHYSGAWSSLCPLRGPLWQTWKTLPTAAAPCSCPLTLPRAGAPQLQRHCQGVAATAAAPSILWCRRPGLYPNGLGAPVCCRKHRSLGRLERPLSQPGRHALPHVTGGLACVHRDHSPPSAKRSDGLHRASLRASETCIALDHCLLLYKWQKSDKIHSDRTC

SEQ ID NO: 842542 - protein, 550 aa, Homo sapiens; identical to SEQ ID NO: 842530

SEQ ID NO: 842543 - protein, 362 aa, Homo sapiens [sequence omitted]

SEQ ID NO: 842544 - protein, 183 aa, Homo sapiens [sequence omitted]

SEQ ID NO: 842545 - protein, 175 aa, Homo sapiens
MVPKADSGAFLLLFLLVLTVTEPLRPGAPRDGGGVGAGRRAGPGSPRDLLSPAAPSCRGRAWGRGGRGLARGPPGTLCGRLLELTWARGASDFVQLCCPGCCLWALPGSGGGQELRHGRTLSPVQRRSRAGDSGSQGHLVSQTSSQQWPSASLSVLETPRLDSGGCGCHSVRRCA

SEQ ID NO: 842546 - protein, 507 aa, Homo sapiens
SFPPLLSSPSAVGEGKVAVAAPCPGRSECARAKMAYIQLEPLNEGFLSRISGLLLCRWTCRHCCQKCYESSCCQSSEDEVEILGPFPAQTPPWLMASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 842547 - protein, 470 aa, Homo sapiens
MLEPLNEGFLSRISGLLLCRWTCRHCCQKCYESSCCQSSEDEVEILGPFPAQTPPWLMASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 842548 - protein, 168 aa, Homo sapiens
MGTFFAFMEKKNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 842549 - protein, 373 aa, Homo sapiens
MLEPLNEGFLSRISGLLLCRWTCRHCCQKCYESSCCQSSEDEVEILGPFPAQTPPWLMASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSAGAWTQTCENQEDVLLKGHN

SEQ ID NO: 842550 - protein, 507 aa, Homo sapiens; identical to SEQ ID NO: 842546

SEQ ID NO: 842551 - protein, 474 aa, Homo sapiens
MAYIQLEPLNEGFLSRISGLLLCRWTCRHCCQKCYESSCCQSSEDEVEILGPFPAQTPPWLMASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 842552 - protein, 413 aa, Homo sapiens
MASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 842553 - protein, 433 aa, Homo sapiens
MLEPLNEGFLSRISGLLLCRWTCRHCCQKCYESSCCQSSEDEVEILGPFPAQTPPWLMASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTGSNSPIPACELSSHPAHGISPWIPSPGN

SEQ ID NO: 842554 - protein, 121 aa, Homo sapiens
SHNFMLRMNKAPTAGFEAAAGSKTAHHLVYPESFRELGDNVSMVLVPLKTMNLEWVVSTTTTGAISHTYTPVLVKIRVKQDKILIYHPAFIKYVFDNWLQSHRRYPLTSILSVIFSMHVCD

SEQ ID NO: 842555 - protein, 1504 aa, Homo sapiens [sequence omitted]

SEQ ID NO: 842556 - protein, 1504 aa, Homo sapiens [sequence omitted]

SEQ ID NO: 842557 - protein, 1391 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKVGSIISDHSSKISGQSCPGIGGAYLQKKILQITRSTAKRTDSTEKATEENRDRTSCENTTRKRMTSPFRRLRERMLSRERLVNSQKEDTDHNQATESCEKVKDVGSNIKDEKGSAIFNSNSQGNSNTLNCFYTRFKSKRRKTL

SEQ ID NO: 842558 - protein, 509 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVGFIRGMKVILTQNFIHETFIVDRLPVYYDNKIQYT

SEQ ID NO: 842559 - protein, 397 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQVRLSLWSSLLVCWFKVAEPVLSSSKENSFI

SEQ ID NO: 842560 - protein, 1674 aa, Homo sapiens
GTSCRSRGLASAQRSDPCLAVASMAPTLFQKLFSKRTGLGAPGRDARDPDCGFSWPLPEFDPSQIRLIVYQDCERRGRNVLFDSSVKRRNEDISVSDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKRRVLESTPAESSEGLDPKDATDPVYKTVTSSTEKGLIVYCVTSPKKDDRYREPPPTPPGYLGISLADLKEGPHTHLKPPDYSVAVQRSKMMHNSLSRLPPASLSSNLVACVPSKIVTQPQRHNLQPFHPKLGDVTDADSEADENEQVSAV

SEQ ID NO: 842561 - protein, 1588 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALKISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKRRVLESTPAESSEGLDPKDATDPVYKTVTSSTEKGLIVYCVTSPKKDDRYREPPPTPPGYLGISLADLKEGPHTHLKPPDYSVAVQRSKMMHNSLSRLPPASLSSNLVACVPSKIVTQPQRHNLQPFHPKLGDVTDADSEADENEQVSAV

SEQ ID NO: 842562 - protein, 1148 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTCEYKFSFM

SEQ ID NO: 842563 - protein, 1067 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQR

SEQ ID NO: 842564 - protein, 101 aa, Homo sapiens
DAQSFYQGRWSGRGCRDCENSWSRRQSFINISSRSCGAVLMRWACDFTKLLSSTWTLIQYPENAMIIARWALLADCPEKTKALRTTGVTAKREFNHRASHV

SEQ ID NO: 842565 - protein, 131 aa, Homo sapiens
NLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTVRS

SEQ ID NO: 842566 - protein, 911 aa, Homo sapiens
MDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 842567 - protein, 862 aa, Homo sapiens
ESNGVTDQAEAEKQYEDSCRVYQASSPDEDLLQIRSYVYAEEPNIDIHNFVGTFTREDSDPPISESLSIENTLWAGTVVASGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 842568 - protein, 602 aa, Homo sapiens
MTRLFGSTNPCAAPVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 842569 - protein, 507 aa, Homo sapiens
HSAGNSTGSRFGLSCGDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 842570 - protein, 219 aa, Homo sapiens
MVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 842571 - protein, 1032 aa, Homo sapiens
MDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVKVKSSNIQVGDLIIVEKNQRVPADMIFLRTSEKNGSCFLRTDQLDGETDWKLRLPVACTQRLPTAADLLQIRSYVYAEEPNIDIHNFVGTFTREDSDPPISESLSIENTLWAGTVVASGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 842572 - protein, 1032 aa, Homo sapiens; identical to SEQ ID NO: 842571

SEQ ID NO: 842573 - protein, 1032 aa, Homo sapiens; identical to SEQ ID NO: 842571

SEQ ID NO: 842574 - protein, 109 aa, Homo sapiens
CFLLPFSFARFVLTSKNDQWIDFWRHLVIASGLIGSFNAKGGSGSGLLWYDDLMPLTATSYNLFVTSSGFSVKERFSGVDIRVRVKVCCHVAQSLCYPSVHAPNPKGAS

SEQ ID NO: 842575 - protein, 1032 aa, Homo sapiens; identical to SEQ ID NO: 842571

SEQ ID NO: 842576 - protein, 576 aa, Homo sapiens
MDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVKVKSSNIQVGDLIIVEKNQRVPADMIFLRTSEKNGSCFLRTDQLDGETDWKLRLPVACTQRLPTAADLLQIRSYVYAEEPNIDIHNFVGTFTREDSDPPISESLSIENTLWAGTVVASGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVREGCVPVLFLWRTRCSSAFSPFPRGATGLDRGCRSS

SEQ ID NO: 842577 - protein, 296 aa, Homo sapiens
MDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVKVKSSNIQVGDLIIVEKNQRVPADMIFLRTSEKNGSCFLRTDQLDGETDWKLRLPVACTQRLPTAADLLQIRSYVYAEEPNIDIHNFVGTFTREDSDPPISESLSIENTLWAGTVVASGTVVGVVLYTGRELRSVMNTSNPRSKVCTRSWGTLTGCGLVGSGG

SEQ ID NO: 842578 - protein, 1032 aa, Homo sapiens; identical to SEQ ID NO: 842571

SEQ ID NO: 842579 - protein, 730 aa, Homo sapiens
MVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 842580 - protein, 481 aa, Homo sapiens
MKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 842581 - protein, 1032 aa, Homo sapiens; identical to SEQ ID NO: 842571

SEQ ID NO: 842582 - protein, 1032 aa, Homo sapiens; identical to SEQ ID NO: 842571

SEQ ID NO: 842583 - protein, 1032 aa, Homo sapiens; identical to SEQ ID NO: 842571

SEQ ID NO: 842584 - protein, 864 aa, Homo sapiens
MDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVKVKSSNIQVGDLIIVEKNQRVPADMIFLRTSEKNGSCFLRTDQLDGETDWKLRLPVACTQRLPTAADLLQIRSYVYAEEPNIDIHNFVGTFTREDSDPPISESLSIENTLWAGTVVASGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIG

SEQ ID NO: 842585 - protein, 343 aa, Homo sapiens
MDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVKVKSSNIQVGDLIIVEKNQRVPADMIFLRTSEKNGSCFLRTDQLDGETDWKLRLPVACTQRLPTAADLLQIRSYVYAEEPNIDIHNFVGTFTREDSDPPISESLSIENTLWAGTVVASGTVVGVVLYTGRELRSVMNTSNPRSKIGLFDLEVNCLTKILFGALVVVSLVMVALQHFAGRWYLQIIRFLLLFSNIIPISLRVNSRMGYSSV

SEQ ID NO: 842586 - protein, 127 aa, Homo sapiens
LVISGDSLEVSLGTPESQSSQQPGSYPASAGALQARQRPPPTHHLSLHQRTTSPSTLQVCLKYYEYEFMELACQCPAVVCCRCAPTQKAQIVRLLQERTGKLTCAVGRRGSGCAAGPGLPVHQAPFP

SEQ ID NO: 842587 - protein, 450 aa, Homo sapiens
MEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAAASPVGAEKLLAPRPGGPLPSRLE

SEQ ID NO: 842588 - protein, 504 aa, Homo sapiens
SQSLHRVHLYNSLRFSVSLPPSLPPPPQSFSPHLSISLLSLQEEPKRRQHQHLLTWKYTDTIGKRKHSIASSRFQVALFGRFYTDLIPVMEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSAAAAACLKQSPFLYATAFWPKSSAAAAAAAAAAAAGPLQLQLPSALTLLPPSFTSLCLPAQNWCAKCNASFRMTSDLVYHMRSHHKKEYAMEPLVKRRREEKLKCPICNESFRERHHLSRHMTSHN

SEQ ID NO: 842589 - protein, 450 aa, Homo sapiens; identical to SEQ ID NO: 842587

SEQ ID NO: 842590 - protein, 450 aa, Homo sapiens; identical to SEQ ID NO: 842587

SEQ ID NO: 842591 - protein, 450 aa, Homo sapiens; identical to SEQ ID NO: 842587

SEQ ID NO: 842592 - protein, 106 aa, Homo sapiens
MVRIADLRHGVPPPPRGTLPLPQRCPLPLESGASLGARESSPENGSSQRLKSFFSGDGARRLFDWGTCFPTISQKASLEECARTEGKSSAPSAMSPSGSATTSPGT

SEQ ID NO: 842593 - protein, 129 aa, Homo sapiens
ARDSPATWCCSPVEGVNLQAVKDLKSLASAAALKGQVSASKWLSAQTRLPRRPRQLHPLLHHPLDVKSFPEPILVIIFIFNHPCPPTPRPQSANSTHYRLPLGLRRTHQAEGGKNPTKTKTNKKKTGTV

SEQ ID NO: 842594 - protein, 539 aa, Homo sapiens
SQSLHRVHLYNSLRFSVSLPPSLPPPPQSFSPHLSISLLSLQEEPKRRQHQHLLTWKYTDTIGKRKHSIASSRFQVALFGRFYTDLIPVMEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAAASPVGAEKLLAPRPGGPLPSRLE

SEQ ID NO: 842595 - protein, 450 aa, Homo sapiens; identical to SEQ ID NO: 842587

SEQ ID NO: 842596 - protein, 450 aa, Homo sapiens; identical to SEQ ID NO: 842587

SEQ ID NO: 842597 - protein, 255 aa, Homo sapiens
DLSRGWWQTGLGAMLSNHVVCVCVCVCVRACVWCLLTKQGRPLTHAWNAANVSSLSSPLSDERKSAFSQPARSFSQLSPLVLGQKLGALEPCHPADGVGPTRLYPAAADPLAVKLQGAADLNGGCGSLPSGGGGLPKQSPFLYATAFWPKSSAAAAAAAAAAAAGPLQLQLPSALTLLPPSFTSLCLPAQNWCAKCNASFRMTSDLVYHMRSHHKKEYAMEPLVKRRREEKLKCPICNESFRERHHLSRHMTSHN

SEQ ID NO: 842598 - protein, 125 aa, Homo sapiens
MEDTGIQRGIWDGDAKAVQQCLTDIFTSVYTTSHSRPGSTHTTAFPGSTTMPGVSQESTASHSSPGSTDTTLSPGSTTASSLGPESTTFHSSPGSTETTLLPDNTTPQASLKHLRPSTMHVIRIL

SEQ ID NO: 842599 - protein, 424 aa, Homo sapiens
MDQPSGRSFMQVLCEKYSPENFPYRRGPGMGVHVPATPQGSPMKDRLNLPSVLVLNSCGITCAGDEKEIAAFCAHVSELDLSDNKLEDWHEVSKIVSNVPQLEFLNLSSNPLNLSVLERTCAGSFSGVRKLVLNNSKASWETVHMILQELPDLEELFLCLNDYETVSCPSICCHSLKLLHITDNNLQDWTEIRKLGVMFPSLDTLVLANNHLNAIEEPDDSLARLFPNLRSISLHKSGLQSWEDIDKLNSFPKLEEVRLLGIPLLQPYTTEERRKLVIARLPSVSKLNGSVVTDGEREDSERFFIRYYVDVPQEEVPFRYHELITKYGKLEPLAEVDLRPQSSAKVEVHFNDQVEEMSIRLDQTVAELKKQLKTLVQLPTSNMLLYYFDHEAPFGPEEMKYSSRALHSFGIRDGDKIYVESKTK

SEQ ID NO: 842600 - protein, 398 aa, Homo sapiens
MDQPSGRSFMQVLCEKYSPENFPYRRGPGMGVHVPATPQGSPMKDRLNLPSVLVLNSCGITCAGDEKEIAAFCAHVSELDLSDNKLEDWHEKEHAAGSFSGVRKLVLNNSKASWETVHMILQELPDLEELFLCLNDYETVSCPSICCHSLKLLHITDNNLQDWTEIRKLGVMFPSLDTLVLANNHLNAIEEPDDSLARLFPNLRSISLHKSGLQSWEDIDKLNSFPKLEEVRLLGIPLLQPYTTEERRKLVIARLPSVSKLNGSVVTDGEREDSERFFIRYYVDVPQEEVPFRYHELITKYGKLEPLAEVDLRPQSSAKVEVHFNDQVEEMSIRLDQTVAELKKQLKTLVQLPTSNMLLYYFDHEAPFGPEEMKYSSRALHSFGIRDGDKIYVESKTK

SEQ ID NO: 842601 - protein, 424 aa, Homo sapiens; identical to SEQ ID NO: 842599

SEQ ID NO: 842602 - protein, 278 aa, Homo sapiens
MDQPSGRSFMQVLCEKYSPENFPYRRGPGMGVHVPATPQGSPMKDRLNLPSVLVLNSCGITCAGDEKEIAAFCAHVSELDLSDNKLEDWHEVCSPGKTIDKLNSFPKLEEVRLLGIPLLQPYTTEERRKLVIARLPSVSKLNGSVVTDGEREDSERFFIRYYVDVPQEEVPFRYHELITKYGKLEPLAEVDLRPQSSAKVEVHFNDQVEEMSIRLDQTVAELKKQLKTLVQLPTSNMLLYYFDHEAPFGPEEMKYSSRALHSFGIRDGDKIYVESKTK

SEQ ID NO: 842603 - protein, 424 aa, Homo sapiens; identical to SEQ ID NO: 842599

SEQ ID NO: 842604 - protein, 118 aa, Homo sapiens
MDQPSGRSFMQVLCEKYSPENFPYRRGPGMGVHVPATPQGSPMKDRLNLPSVLVLNSCGITCAGDEKEIAAFCAHVSELDLSDNKLEDWHEKEHVLGPSLGFANLSSTTAKLLGRRST

SEQ ID NO: 842605 - protein, 127 aa, Homo sapiens
MDQPSGRSFMQVLCEKYSPENFPYRRGPGMGVHVPATPQGSPMKDRLNLPSVLVLNSCGITCAGDEKEIAAFCAHVSELDLSDNKLEDWHEVKFLYCYILVKSSNNHCVIVYVIICSAKFCSHLMSV

SEQ ID NO: 842606 - protein, 434 aa, Homo sapiens
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAKQAEMEVKRESYARERSTVARIQFRLPDGSSFTNQFPSDAPLEEARQFAAQTVGNTYGNFSLATMFPRREFTKEDYKKKLLDLELAPSASVVLLPVCLLISRQEDQLHPLYTLPAETFGPCWEQCFIHSLPSGD

SEQ ID NO: 842607 - protein, 397 aa, Homo sapiens [sequence omitted]

SEQ ID NO: 842608 - protein, 250 aa, Homo sapiens
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRM

SEQ ID NO: 842609 - protein, 490 aa, Homo sapiens
MLWFQGAIPAAIATAKRSGAVFVVFVAGDDEQSTQMAASWEDDKVTEASSNSFVAIKIDTKSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAKQAEMEVKRESYARERSTVARIQFRLPDGSSFTNQFPSDAPLEEARQFAAQTVGNTYGNFSLATMFPRREFTKEDYKKKLLDLELAPSASVVLLPAGRPTASIVHSSSGDIWTLLGTVLYPFLAIWRLISNFLFSNPPPTQTSVRVTSSEPPNPASSSKSEKREPVRKRVLEKRGDDFKKEGKIYRLRTQDDGEDENNTWNGNSTQQM

SEQ ID NO: 842610 - protein, 397 aa, Homo sapiens [sequence omitted]

SEQ ID NO: 842611 - protein, 274 aa, Homo sapiens
MLDYKRKQEEELTKRMLEERNREKAEDRAARERIKQQIALDRAERAARFAKTKEEVEAAKAAALLAKQAEMEVKRESYARERSTVARIQFRLPDGSSFTNQFPSDAPLEEARQFAAQTVGNTYGNFSLATMFPRREFTKEDYKKKLLDLELAPSASVVLLPAGRPTASIVHSSSGDIWTLLGTVLYPFLAIWRLISNFLFSNPPPTQTSVRVTSSEPPNPASSSKSEKREPVRKRVLEKRGDDFKKEGKIYRLRTQDDGEDENNTWNGNSTQQM

SEQ ID NO: 842612 - protein, 274 aa, Homo sapiens; identical to SEQ ID NO: 842611

SEQ ID NO: 842613 - protein, 144 aa, Homo sapiens
MFPRREFTKEDYKKKLLDLELAPSASVVLLPAGRPTASIVHSSSGDIWTLLGTVLYPFLAIWRLISNFLFSNPPPTQTSVRVTSSEPPNPASSSKSEKREPVRKRVLEKRGDDFKKEGKIYRLRTQDDGEDENNTWNGNSTQQM

SEQ ID NO: 842614 - protein, 508 aa, Homo sapiens
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAKQAEMEVKRESYARERSTVARIQFRLPDGSSFTNQFPSDAPLEEARQFAAQTVGNTYGNFSLATMFPRREFTKEDYKKKLLDLELAPSASVVLLPAGRPTASIVHSSSGDIWTLLGTVLYPFLAIWRLISNFLFSNPPPTQTSVRVTSSEPPNPASSSKSEKREPVRKRVLEKRGDDFKKEGKIYRLRTQDDGEDENNTWNGNSTQQM

SEQ ID NO: 842615 - protein, 413 aa, Homo sapiens
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAKQAEMEVKRESYARERSTVARIQFRLPDGSSFTNQFPSDAPLEEARQFAAQTVGNTYGNFSLATMFPRREFTKEDYKKKLLDLELAPSASVVLLPQEDQLHPLTLYLLVTRCR

SEQ ID NO: 842616 - protein, 322 aa, Homo sapiens
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAKQAEMEVKRESYARERRYYISC

SEQ ID NO: 842617 - protein, 508 aa, Homo sapiens; identical to SEQ ID NO: 842614

SEQ ID NO: 842618 - protein, 246 aa, Homo sapiens
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERRRREVTEEEKTKEEKPEAKGVKEEVKLAWMDLSSSGF

SEQ ID NO: 842619 - protein, 508 aa, Homo sapiens; identical to SEQ ID NO: 842614

SEQ ID NO: 842620 - protein, 508 aa, Homo sapiens; identical to SEQ ID NO: 842614

SEQ ID NO: 842621 - protein, 274 aa, Homo sapiens; identical to SEQ ID NO: 842611

SEQ ID NO: 842622 - protein, 257 aa, Homo sapiens
MLDYKRKQEEELTKRMLEERNREKAEDRAARERIKQQIALDRAERAARFAKTKEEVEAAKAAALLATVARIQFRLPDGSSFTNQFPSDAPLEEARQFAAQTVGNTYGNFSLATMFPRREFTKEDYKKKLLDLELAPSASVVLLPAGRPTASIVHSSSGDIWTLLGTVLYPFLAIWRLISNFLFSNPPPTQTSVRVTSSEPPNPASSSKSEKREPVRKRVLEKRGDDFKKEGKIYRLRTQDDGEDENNTWNGNSTQQM

SEQ ID NO: 842623 - protein, 508 aa, Homo sapiens; identical to SEQ ID NO: 842614

SEQ ID NO: 842624 - protein, 508 aa, Homo sapiens; identical to SEQ ID NO: 842614

SEQ ID NO: 842625 - protein, 305 aa, Homo sapiens
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAYYISC

SEQ ID NO: 842626 - protein, 182 aa, Homo sapiens
MNSLHRWLQVGKMIKLQKHLQTVLLLLKSIPKVKPAYSFHKSTSLNCTDPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLYPR

SEQ ID NO: 842627 - protein, 117 aa, Homo sapiens
MSPSCKPRAAEAPRAEPKKDEAGDGERSAACRDPQPLSPGRSSPSGQEKALLCRCPSPRPKRCFLTAWTQLDGGERALGAGLRASSRLLPTRSGKVPNLPEPQLPNLANMTTKVLLF

SEQ ID NO: 842628 - protein, 74 aa, Homo sapiens
LVLLCCCCYAGRAAPCSPGVLPFYRHSYPVHLTTGHLRLGVFSLNTPKPSTKPLCFRLPVSVSASTAHPSAQAP

SEQ ID NO: 842629 - protein, 224 aa, Homo sapiens
MPGSPRPAPSWVLLLRLLALLRPPGLGEACSCAPAHPQQHICHSALVIRAKISSEKVVPASADPADTEKMLRYEIKQIKMFKGFEKVKDVQYIYTPFDSSLCGVKLEANSQKQYLLTGQVLSDGKVFIHLCNYIEPWEDLSLVQRESLNHHYHLNCGCQITTCYTVPCTISAPNECLWTDWLLERKLYGYQAQHYVCMKHVDGTCSWYRGHLPLRKEFVDIVQP

SEQ ID NO: 842630 - protein, 224 aa, Homo sapiens; identical to SEQ ID NO: 842629

SEQ ID NO: 842631 - protein, 224 aa, Homo sapiens; identical to SEQ ID NO: 842629

SEQ ID NO: 842632 - protein, 145 aa, Homo sapiens
MFKGFEKVKDVQYIYTPFDSSLCGVKLEANSQKQYLLTGQVLSDGKVFIHLCNYIEPWEDLSLVQRESLNHHYHLNCGCQITTCYTVPCTISAPNECLWTDWLLERKLYGYQAQHYVCMKHVDGTCSWYRGHLPLRKEFVDIVQP

SEQ ID NO: 842633 - protein, 80 aa, Homo sapiens
CQLLQKNSHTALLSTVLPVPTTPHDTYEGTTSREEKQCESFSVEAELSACALRLPERVRWRSPSFHASGNLAVYRSNPVW

SEQ ID NO: 842634 - protein, 77 aa, Homo sapiens
NPCLGNLSSSGREAFRAERQPVPGSAIALSVGRAHHGASSGLISLSTPFLYFCLPRSCSENVLHVGRFIPFTSSSFI

SEQ ID NO: 842635 - protein, 117 aa, Homo sapiens
LPPAFLSARLSSARLLCAHAGLAARRGRSRGPARAAGTLPAQPSGPFSLRPPPGVGPGCVLANCASGIRSGMPSCLAKGVTPSSTQSLSSVTCCRRLFPRGAGSPRFVCQQLGGEYL

SEQ ID NO: 842636 - protein, 117 aa, Homo sapiens; identical to SEQ ID NO: 842635

SEQ ID NO: 842637 - protein, 123 aa, Homo sapiens
NDFLKLSPVPKFCHKCRVHLKMTFPKTIHVKFSFQILNSDMRMRNKKDPDELPGNPISQSWFKKKKDLNTFTQVCLSSYNILGTMDRDKDSDLKLSLLRREQYGVVSEKEKHRMQTSIQIAVN

SEQ ID NO: 842638 - protein, 31 aa, Homo sapiens
RWHSGEKHKKEKSHMSGKTQQSSLLLKPEVL

SEQ ID NO: 842639 - protein, 164 aa, Homo sapiens
DQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVL

SEQ ID NO: 842640 - protein, 88 aa, Homo sapiens [sequence omitted]

SEQ ID NO: 842641 - protein, 110 aa, Homo sapiens
MATAALWPPLHPDGAWPGRSILESEASTCVSLKPLRACPAVLLPSSTSGSSLSSQHCGRPRRVDHLRTGVQDQPGQHGYMESTGVSASGEAPGSFQPWWKAKREQVSHMA

SEQ ID NO: 842642 - protein, 281 aa, Homo sapiens
SLSSLFPAPAPPPAPAFAPPPKVPSPERSAPRVPLPSPQPSYPFRPAASGGTPPPACLPPAQPCQGSPAMNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 842643 - protein, 281 aa, Homo sapiens; identical to SEQ ID NO: 842642

SEQ ID NO: 842644 - protein, 208 aa, Homo sapiens
MLARYSVDHRVLLHAYKICRSPRSCAGISGKSQVLFAVVFTARYLDLFTNYISLYNTCMKVVYIACSFTTVWLIYSKFKATYDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 842645 - protein, 155 aa, Homo sapiens
PNPGSVILELAEPMAIRYYVKQQGILHMQDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 842646 - protein, 154 aa, Homo sapiens
CVSAVMECPRYTLVVEICGSVSVTKRDSEGTLVVPTKKSPDLFSRPVPSHLIMSPASLQILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 842647 - protein, 149 aa, Homo sapiens
MALQPPNMRRICLKYLLLTTHCCFWLAVLAVMAVGIWTLALKSDYISLLPQAPTWPQPTILGVGGERPLSTQPMVSKTGEAETITSHYLFALGVYRTLYLFNWIWRYHFEGFFDLIAIVAGLVQTVLYCDFFYLYITKVLKGKKLSLPA

SEQ ID NO: 842648 - protein, 281 aa, Homo sapiens; identical to SEQ ID NO: 842642

SEQ ID NO: 842649 - protein, 281 aa, Homo sapiens; identical to SEQ ID NO: 842642

SEQ ID NO: 842650 - protein, 150 aa, Homo sapiens
MKVVYIACSFTTVWLIYSKFKATYDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 842651 - protein, 303 aa, Homo sapiens
SLSSLFPAPAPPPAPAFAPPPKVPSPERSAPRVPLPSPQPSYPFRPAASGGTPPPACLPPAQPCQGSPAMNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEEDRPGWPDVLIFSTEAIIQEFQILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 842652 - protein, 281 aa, Homo sapiens; identical to SEQ ID NO: 842642

SEQ ID NO: 842653 - protein, 281 aa, Homo sapiens; identical to SEQ ID NO: 842642

SEQ ID NO: 842654 - protein, 80 aa, Homo sapiens
MNEHVESRRQCSLVVGSTDPFQTTWIQIPALPFGQPTNLCVSVPFSVEWREQQHLPYGTAVQMKQGRMFKALSTQWALRK

SEQ ID NO: 842655 - protein, 413 aa, Homo sapiens
RTWDWAGALADGDMLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQMKRQGAQVTTERTVQLNVSYAPQTITIFRNGIALEILQNTSYLPVLEGQALRLLCDAPSNPPAHLSWFQGSPALNATPISNTGILELRRVRSAEEGGFTCRAQHPLGFLQIFLNLSVYSLPQLLGPSCSWEAEGLHCRCSFRARPAPSLCWRLEEKPLEGNSSQGSFKVNSSSAGPWANSSLILHG

SEQ ID NO: 842656 - protein, 141 aa, Homo sapiens
DVQKKNCSLSIGDARMEDTGSYFFRVERGRDVKYSYQQNKLNLEVTGMAGTPGEDPGTWRPPYENRDRSWAGAAGGGVGLGAGRGLRPGHSRGHTLRPQAPGAQVSPCLLLSPDRETRHPLSGASGVRPPHKAELQPSRIL

SEQ ID NO: 842657 - protein, 107 aa, Homo sapiens
MSHHWGYGKHNGPEHWHKDFPIAKGERQSPLRHPTTSRARRTLLSLAPERGSGAPGATRGSSDRRPGYPSGPSDRAPGSAWAWTDRSCGASGRAAADGGSWAHVPPR

SEQ ID NO: 842658 - protein, 242 aa, Homo sapiens
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDNFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 842659 - protein, 246 aa, Homo sapiens
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKLPESLDYWTYPGSLTTPPLLECVTWIVLKEPISVSSEQVLKFRKLNFNGEGEPEELMVDNWRPAQPLKNRQIKASFK

SEQ ID NO: 842660 - protein, 136 aa, Homo sapiens
GIVGESCATACSVTAVAYDHCPVKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 842661 - protein, 117 aa, Homo sapiens
ARIMIDWPSLLKVRCQYRLQNYVDLTGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 842662 - protein, 125 aa, Homo sapiens
MSHHWGYGKHNGPEHWHKDFPIAKGERQSPVDIDTHTAKYDPSLKPLSVSYDQATSLRILNNGHAFNVEFDDSQDKAGQCLENNLCLLASSCFPSLMEGARNSGRNPLNNTVCLRTQGCHPDHFH

SEQ ID NO: 842663 - protein, 125 aa, Homo sapiens; identical to SEQ ID NO: 842662

SEQ ID NO: 842664 - protein, 260 aa, Homo sapiens
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 842665 - protein, 105 aa, Homo sapiens
MSHHWGYGKHNGPEHWHKDFPIAKGERQSPVDIDTHTAKYDPSLKPLSVSYAFQGNLWRLLSPRTVYPSGTTDMGTQYVTEHIGSRSNRSSGRVARLRWILGSSD

SEQ ID NO: 842666 - protein, 260 aa, Homo sapiens; identical to SEQ ID NO: 842664

SEQ ID NO: 842667 - protein, 244 aa, Homo sapiens
TSAERRDRVLSDKEGRVASLGRVRTPAQRPSNGREEGRCSQGKVETHFPDHRRRVLPGELWAVRPPCRVASYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 842668 - protein, 131 aa, Homo sapiens
ARIMIDWPFNKHCVKGWAYAQIQGTSEKVVDVLASNSKRTGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 842669 - protein, 106 aa, Homo sapiens
ILEYPRSSCYTIKTNGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 842670 - protein, 102 aa, Homo sapiens
LFVETGSCYSAQAGLKLFASRDPSASASQSAGITGSGHLLLLPFLCGQSPTLEISIIGGRVSITAHWVHSMASSLGSEFPPVQCSSPASVTSISYLDYCNGS

SEQ ID NO: 842671 - protein, 985 aa, Homo sapiens
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 842672 - protein, 1050 aa, Homo sapiens
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 842673 - protein, 985 aa, Homo sapiens; identical to SEQ ID NO: 842671

SEQ ID NO: 842674 - protein, 267 aa, Homo sapiens
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEGL

SEQ ID NO: 842675 - protein, 648 aa, Homo sapiens
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQYGVSLCHPGWSAVALSLLTASSASRVHAILLPQPPE

SEQ ID NO: 842676 - protein, 70 aa, Homo sapiens
RFYLVYLRLQLKFQQREKMDKRKLGRRPSSSDKKDVKCKTRGCPCSITTVQIQKLRTLDSPFAVGKKPKE

SEQ ID NO: 842677 - protein, 1017 aa, Homo sapiens
MLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 842678 - protein, 858 aa, Homo sapiens
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNES

SEQ ID NO: 842679 - protein, 202 aa, Homo sapiens
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERGSQRSKTVDDNSAKQTAHNKEKRRKDDGISLLISDTQPEGL

SEQ ID NO: 842680 - protein, 238 aa, Homo sapiens
MKKFLYIKSVFHTLRMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 842681 - protein, 335 aa, Homo sapiens
PHRPGSLEPAACSPAPPAMVVSGAPPALGGGCLGTFTSLLLLASTAILNAARIPVPPACGKPQQLNRVVGGEDSTDSEWPWIVSIQKNGTHHCAGSLLTSRWVITAAHCFKDNLNKPYLFSVLLGAWQLGNPGSRSQKVGVAWVEPHPVYSWKEGACADIALVRLERSIQFSERVLPICLPDASIHLPPNTHCWISGWGSIQDGVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 842682 - protein, 267 aa, Homo sapiens
FNLGAPRFYLEALLPSGAFTPMLFPQVPPPRPGLADPPLPFPSSNLNKPYLFSVLLGAWQLGNPGSRSQKVGVAWVEPHPVYSWKEGACADIALVRLERSIQFSERVLPICLPDASIHLPPNTHCWISGWGSIQDGVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 842683 - protein, 320 aa, Homo sapiens
FNLGAPRFYLEALLPSGAFTPMLFPQVPPPRPGLADPPLPFPSSNLNKPYLFSVLLGAWQLGNPGSRSQKVGVAWVEPHPVYSWKEGACADIALVRLERSIQFSERVLPICLPDASIHLPPNTHCWISGWGSIQDGGASSRARIADFQSTICRPQSVDQLQQSQCWMKYAVSETGRALTICGYKKIYKRVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 842684 - protein, 185 aa, Homo sapiens
PHRPGSLEPAACSPAPPAMVVSGAPPALGGGCLGTFTSLLLLASTAILNAARIPVPPACGKPQQLNRVVGGEDSTDSEWPWIVSIQKNGTHHCAGSLLTSRWVITAAHCFKDNLNKPYLFSVLLGAWQLGNPGSRSQKVGVAWVEPHPVYSWVEKIVQGVQLRGRAQGGGALRAPSQGSGAAARS

SEQ ID NO: 842685 - protein, 232 aa, Homo sapiens
LSPSWPCLSHLLSASALFISCSLTALCLGFFYGCEDETENAASTQRASVSSYRRRRHRLLPLASVFSHLLVLRCLPLGKHRFVLFLPQEVRGGPPAAAASRAEGLRSVPPSRSRSWSPEGRLDGKLREGRVTAVQPGPGQAPGNAPPVGALGLRDLRVSLGTGGLEVPHHQVLKGTPSSLGAGTPAHWALGPLLTGRWDPLLTERWDPLVTGRWGPLLTGRWGALLTGRWGP

SEQ ID NO: 842686 - protein, 175 aa, Homo sapiens
MLVWATPGAPSCARWTAPGCWPASSAGARAVPSATGPGSTSASLRTAPGWRRSCKGCSSAGALRGVGPSGHRARALGPPRAPRAQRDAGLGSERRPDPHLDLDLRRPRAVSPAVNRLIYLYLWGPGRLLRKGNPLPDPPDGLRPRLQGIRPRPTASCPRPHDFRPRPRAPALLCI

SEQ ID NO: 842687 - protein, 66 aa, Homo sapiens
IALGLSSLLPAPPPHQPWWFLERPQPWVGAVSAPSPPCCCWRRQVRPEAAPPSSLSPPPSFPPSLP

SEQ ID NO: 842688 - protein, 130 aa, Homo sapiens
MYNNKDHLHAFIIQYYRCVKYLCHMQGDAPSSQQVSPTAQQIPPTTDSVRRALTCESTLFAKFQCVTQFLAKHIGFGFCYVLFKAFSQIHMHTIGWGLSNICWIQARSLYYPTPHLDGSSVHQLAEFCLS

SEQ ID NO: 842689 - protein, 107 aa, Homo sapiens
MIISYTPNIPLGVSGTAVLQSPRLWDPACLPLMAAARGLPRTPPKADAVWTMCGQHLSRSEACVPWPVLWACLVAAHLSGMRPRTRRVPNAVCFFSPSAQGFFRGMF

SEQ ID NO: 842690 - protein, 255 aa, Homo sapiens
KITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPGSGDTESGSCEANSPGN

SEQ ID NO: 842691 - protein, 197 aa, Homo sapiens
KITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLKSATFGASFALRREAERLHESHRSYLPPPRKAFRS

SEQ ID NO: 842692 - protein, 115 aa, Homo sapiens
SFYFILQGVSNLENAKPKKRKLFRRFMSENKIFEGKTVNDKIWQEHSKHKNDSHIRRPCQLKDLNEDDFLSNNIHTYQGKTLQGTSYQVTSECWSPFHYQRHVETTVDELAQEFM

SEQ ID NO: 842693 - protein, 181 aa, Homo sapiens
QSYFSKQGNKRVKLVKMNLFCISLEGSMDSLYEPIPEQQANQENMSSRTDSPIPPFGESEQTPNNLFVGVSNLENAKPKKRKLFRRFMSENKIFEGKTVNDKIWQEHSKHKNDSHIRRPCQLKDLNEDDFLSNNIHTYQGKTLQGTSYQVTSECWSPFHYQRHVETTVDELVRHFFPDVTI

SEQ ID NO: 842694 - protein, 249 aa, Homo sapiens
RLCEFSQTVREERRSSVADRLALHELLAGTSSACKGVEGQALGWPGPPAPHAAPAQPSCSPLLFHRQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDSQNRFGMP

SEQ ID NO: 842695 - protein, 106 aa, Homo sapiens
MQQQGAPRPPQRHAQGCDRAVSTPSCLQAPCHLTISSILHTLPQNLKQGYMAKLPGGRPYLNGIPASMAVEPSPSMAAMVFDKGTGNMAPTVSLPGRGGVSDPVIL

SEQ ID NO: 842696 - protein, 1523 aa, Homo sapiens
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIAKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 842697 - protein, 1427 aa, Homo sapiens
RLCEFSQTVREERRSSVADRLALHELLAGTSSACKGVEGQALGWPGPPAPHAAPAQPSCSPLLFHRQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIAKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 842698 - protein, 1327 aa, Homo sapiens
RLCEFSQTVREERRSSVADRLALHELLAGTSSACKGVEGQALGWPGPPAPHAAPAQPSCSPLLFHRQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIAKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 842699 - protein, 492 aa, Homo sapiens
SPPSVPGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 842700 - protein, 1364 aa, Homo sapiens
RLCEFSQTVREERRSSVADRLALHELLAGTSSACKGVEGQALGWPGPPAPHAAPAQPSCSPLLFHRQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIAKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQDSSLMELGQPCGTPW

SEQ ID NO: 842701 - protein, 865 aa, Homo sapiens
RLCEFSQTVREERRSSVADRLALHELLAGTSSACKGVEGQALGWPGPPAPHAAPAQPSCSPLLFHRQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIAKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSRLQLDGVGTAMWDPLVIQHEGNEAGEEGKEEENIKYIVK

SEQ ID NO: 842702 - protein, 333 aa, Homo sapiens [sequence omitted]

SEQ ID NO: 842703 - protein, 133 aa, Homo sapiens
TKNSWYLFELAEPALPGAVHLYGDSGAMQQQGAPRPPQRHAQGCDRAVSTPSCLQAPCHLTISSILHTLPQNLKQGYMAKLPGGRPYLNGIPASMAVEPSPSMAAMVFDKGTGNMAPTVSLPGRGGVSDPVIL

SEQ ID NO: 842704 - protein, 1075 aa, Homo sapiens
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLNLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 842705 - protein, 736 aa, Homo sapiens
MVENRKTQQGTCLLFHRILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 842706 - protein, 623 aa, Homo sapiens
MPKSKCLINRRARIWAQAVCLQNLLTQPLNHPASHGKETHPAFEDPTACDKNSHKNGQLPYYIKELLSGNTSNGSGCPEEGTSSPRSLRMNRSLPEGERELNFPGSGLLKSNEIWPGLACLGKSQNLGWQEYGKHTEEQREMEVGRKVGFSPQRAVHAKLGHRCQQGCLRKGESKTSSGLGRELWQHKGLKEETELSPKMDLRAPCGLLLWLENTAGQMDHKCLWWLRSSALEEDPGICPTPFPTSISPSPPPLPHPPSPPRQVDLSLIPPPMPLLASPHPAQSLLSLPSQEPHRGSLASWEESPGCQLSLCLPKEPETSLLLITLGPILNPAPINQDSKRARSVPYNFEPSPSSLEALTLRNAKCKDHEENSPRNEAPLTNDELKRSLLEQSHSRNRTFHEAEKSSVNLLLKKCGSVFVWQCTWAEEAAQAVSPLSRIQEREKKFSSTQPGAVRWPMRLCIYKFFVKCKLKTLNVRCCCYYYCCCCCYGHAKRPLLEDSFAFSIIIARNSSLMLQKDEKKGKKRDNSQAQREKKGGGKEPQGDLRKGQDQDDLTFPFTRNKAIARLNPKVKAVTHCLCWEQKPIATSDLAPQTQDPRYQSWRSHRALLVGRKTEGRTNGRMR

SEQ ID NO: 842707 - protein, 1028 aa, Homo sapiens
RLCEFSQTVREERRSSVADRLALHELLAGTSSACKGVEGQALGWPGPPAPHAAPAQPSCSPLLFHRQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIAKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSRTMGGGCSQKGPLTALGAA

SEQ ID NO: 842708 - protein, 292 aa, Homo sapiens [sequence omitted]

SEQ ID NO: 842709 - protein, 387 aa, Homo sapiens
GRLAEESMASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPLRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGIPTPGRSRAFTRKSFHGCLENLYYNGVDVTELAKKHKPQILMMELAHGLQDQNLKISLTVCHQTTQ

SEQ ID NO: 842710 - protein, 186 aa, Homo sapiens
MELSAAAGRRRQAPWREFTGRHRTERSQERGSTPRKERSMGSRQPRKREREPRDCTPTCTNAASVSRSGARRAPGCAGRCITMKNCARAWRELSERACCFQAVPPSNMKQSWLIFLDTTLCSAWLLASSCPRLYAPLISFHCMCFNTVLLFPRLFGPTLSAKIQFNTDLSLRAIAWKCTKDTTTYC

SEQ ID NO: 842711 - protein, 114 aa, Homo sapiens
LVQCGHGGIDKHRVYRCHISAVPFPWTDVAPSIPLKSIKSSLTFVFHFFFQHFHELPRHSFLQRSTFLQIFIAILDTQLQTQNVSTGSTHNANNCFLRKSRVSRRQPTSDVSFS

SEQ ID NO: 842712 - protein, 121 aa, Homo sapiens
MDWSSWAPKALGAAFPETPRWKGGKEELSERACCFQAVPPSNMKQSWLIFLDTTLCSAWLLASSCPRLYAPLISFHCMCFNTVLLFPRLFGPTLSAKIQFNTDLSLRAIAWKCTKDTTTYC

SEQ ID NO: 842713 - protein, 106 aa, Homo sapiens
MDWSSWAPKALGAAFPETPRWKGGKEEPHTLAFCEKIGAHPRVPQAFGICLLSGARERGGQVPNLASGLSWQLALRSSPWNPGPTVLPAPCLFFSFSFSHCLFLNL

SEQ ID NO: 842714 - protein, 1657 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 842715 - protein, 1657 aa, Homo sapiens; identical to SEQ ID NO: 842714

SEQ ID NO: 842716 - protein, 1657 aa, Homo sapiens; identical to SEQ ID NO: 842714

SEQ ID NO: 842717 - protein, 1166 aa, Homo sapiens
WSSLQSSANAALSPQALGCRHAVDSRCSAQRSVLVHLVQVEMRFPIVSKGVCTQQKALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 842718 - protein, 792 aa, Homo sapiens [sequence omitted]

SEQ ID NO: 842719 - protein, 333 aa, Homo sapiens
WRITICLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 842720 - protein, 1657 aa, Homo sapiens; identical to SEQ ID NO: 842714

SEQ ID NO: 842721 - protein, 1657 aa, Homo sapiens; identical to SEQ ID NO: 842714

SEQ ID NO: 842722 - protein, 1657 aa, Homo sapiens; identical to SEQ ID NO: 842714

SEQ ID NO: 842723 - protein, 1508 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARVLHSGDRGDPALFKAERLERQ

SEQ ID NO: 842724 - protein, 1093 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVVTHSRMCNNDNNKKQVI

SEQ ID NO: 842725 - protein, 944 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQVWPSASGGLGTVHPAL

SEQ ID NO: 842726 - protein, 944 aa, Homo sapiens; identical to SEQ ID NO: 842725

SEQ ID NO: 842727 - protein, 796 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQVFQNLSHRQQAGI

SEQ ID NO: 842728 - protein, 404 aa, Homo sapiens [sequence omitted]

SEQ ID NO: 842729 - protein, 407 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNNADKRIKVAIARGGDGMVMDDPYYLAVHQGEATSCTHVDIQLKYYRPSRDIPNRDQTDDQVTIDSDTGHPEVHVWLSTCANNKHLDEARVEEYKLKKMWKSPT

SEQ ID NO: 842730 - protein, 1657 aa, Homo sapiens; identical to SEQ ID NO: 842714

SEQ ID NO: 842731 - protein, 1657 aa, Homo sapiens; identical to SEQ ID NO: 842714

SEQ ID NO: 842732 - protein, 843 aa, Homo sapiens
GSEVAGDLDSAFELGASCQDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 842733 - protein, 487 aa, Homo sapiens
LEDPGKTRGGDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 842734 - protein, 311 aa, Homo sapiens
MRASCSHQALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 842735 - protein, 1657 aa, Homo sapiens; identical to SEQ ID NO: 842714

SEQ ID NO: 842736 - protein, 1297 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPDPGK

SEQ ID NO: 842737 - protein, 747 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEA

SEQ ID NO: 842738 - protein, 135 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKVTYLR

SEQ ID NO: 842739 - protein, 228 aa, Homo sapiens
MVGKPGSGKCWGARMRGRDGQGGQKSRFGSCPARPLTLLSCRPYASRAMTSHTGFGCLAVRLQDEGVYECRVSDYSDDDTQEHKAQAMLRVLSRFAPPNMQAAEAVSHIQSSGPRRHGPASAANANNAGAASRTTSEPGRGDKSPPPGSPPAAIDPAVPEAAAASAAHTPTTTVAAAAAASSASPPSGQAVLLRQRHGSGTGRSYTTDPLLSLLLLALHKFLRLLLGH

SEQ ID NO: 842740 - protein, 758 aa, Homo sapiens
GPGASMMEERAAAAVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 842741 - protein, 67 aa, Homo sapiens
LGEAGLGGNDRGDHRGQHSPLGPSSGSLELHRLIRPLSSLCGWYFDPQFTDVGPDAQTLCNLAIEAL

SEQ ID NO: 842742 - protein, 644 aa, Homo sapiens
APSHIALCVCTRASTGNSLDGELLERGCAYVRFWCMLLSGPLRGCLGLHWPLWYMKKPRGCLTHVALHPCRYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 842743 - protein, 428 aa, Homo sapiens
VTYARLGWNCWVTPALCLDPAESRRVKLQGILADLRDVDGLPPKVTGPPPGTPQPRPHEDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 842744 - protein, 758 aa, Homo sapiens; identical to SEQ ID NO: 842740

SEQ ID NO: 842745 - protein, 758 aa, Homo sapiens; identical to SEQ ID NO: 842740

SEQ ID NO: 842746 - protein, 353 aa, Homo sapiens
SIRLVRGRVLIGRGCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 842747 - protein, 758 aa, Homo sapiens; identical to SEQ ID NO: 842740

SEQ ID NO: 842748 - protein, 714 aa, Homo sapiens
GPGASMMEERAAAAVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSATQINKCESSNRLSHYAREGVRSGQRQEPGPGGPGGSAKGPASVVSRGRVRAHNGWKARKEALGPSLGAQLQSL

SEQ ID NO: 842749 - protein, 148 aa, Homo sapiens
GPGASMMEERAAAAVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGIAQHS

SEQ ID NO: 842750 - protein, 137 aa, Homo sapiens
WVWALATKPGRAPSYLSFDTCQDSCLLCSAVFGRNAAGKDGKERLGGSVLGQIPFLQNCEDEDSDEDDELDSVQHKKQRVKVSPSSMPCTAWPGCDLIEALPSQPGPSGAAVCAGSRDMETHRPWPGGACGQQRPCK

SEQ ID NO: 842751 - protein, 765 aa, Homo sapiens
GPGASMMEERAAAAVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEGSFGFSSDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 842752 - protein, 567 aa, Homo sapiens
MRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEGSFGFSSDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 842753 - protein, 365 aa, Homo sapiens
MDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 842754 - protein, 758 aa, Homo sapiens; identical to SEQ ID NO: 842740

SEQ ID NO: 842755 - protein, 758 aa, Homo sapiens; identical to SEQ ID NO: 842740

SEQ ID NO: 842756 - protein, 138 aa, Homo sapiens
KDPVSLRLSASTLSREQVTRSPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 842757 - protein, 136 aa, Homo sapiens
CGRLWESLVQSFHSLRRGPEWEGNLPPALLASGKPVHSMVAHLDAVTCLAVDPNGAFLMSGSKLSTLVPPGLGRRGGRGLGTGSRQVLRGPRGPGLGEAGLGGNDRGDHRGQHSPLGPSSGSLELHRLIRPLSSLC

SEQ ID NO: 842758 - protein, 78 aa, Homo sapiens
DPDDSPLESTPESTRTKDPAPVSVPHSGPAAGRAMRPDSGLGNTTVAPTSTRPQALPSCPAAAQTLGSVQRGITEAPG

SEQ ID NO: 842759 - protein, 338 aa, Homo sapiens
GAAGITIQRERPPRRADPDVLTAGALIQAGLLPGTAVTISQGQVLVPTPTAQGRPGWSSHCGDEGSSTGGGEQSPQTSQQPQPPCAWPAPTASPSPPGPTDTDEWTETPKTSCPLHVCLHMFGDSSENVISFEGVWEAQRYLRSFWTFKPVPRCGLNREAALPFTEVSCVTHKLTEGTPSASSCVLRRRPCLKRSVKAAVQREVTLLCSELCSLPAGLDRCTSRAPRNRVSGQGPLCAFLGVHVPAVTTSRGWAEKQTPLGKLALSLPSPIPGAEVLVRPQGQVHARTVRVLSCGLWPHVTPTRVVGSLAWVVAMARPPSCPRCPGLVTTQAGGGPTW

SEQ ID NO: 842760 - protein, 338 aa, Homo sapiens; identical to SEQ ID NO: 842759

SEQ ID NO: 842761 - protein, 352 aa, Homo sapiens
LSDRGPPRGQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLESLGLLAQGYVDRRCKGTWVSGRAGQETGHRSPLDSRTKAFWKKGDLSDVGGLLLQTDDEKALGMTLFRNLNGPRYGERIR

SEQ ID NO: 842762 - protein, 801 aa, Homo sapiens
MLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 842763 - protein, 1082 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCAPRALGTPTSHWRRTSSSTWSTGWVPSLRTPSPRQVSGAGRVQHCGGPGGAWEAMRWEKSRRVPPTRASAWLGMPQTPRPLATTSRVRLAGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 842764 - protein, 425 aa, Homo sapiens [sequence omitted]

SEQ ID NO: 842765 - protein, 1043 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 842766 - protein, 188 aa, Homo sapiens
MVILEDPERVMRLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 842767 - protein, 1043 aa, Homo sapiens; identical to SEQ ID NO: 842765

SEQ ID NO: 842768 - protein, 1043 aa, Homo sapiens; identical to SEQ ID NO: 842765

SEQ ID NO: 842769 - protein, 1043 aa, Homo sapiens; identical to SEQ ID NO: 842765

SEQ ID NO: 842770 - protein, 1042 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRGS

SEQ ID NO: 842771 - protein, 1006 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGNPASSTASSAGSASAAARAPQSRVVSPPRPWC

SEQ ID NO: 842772 - protein, 1054 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAPGLPPPAAIPRLLTYLAPELWSKP

SEQ ID NO: 842773 - protein, 1036 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGAQGREPTPSMVLSGPGSHTASTAAHSDDALGLHLSSSSHGVPVAPAPAQPQVSPGPPQAARPPSPCSHPKAPDLPGP

SEQ ID NO: 842774 - protein, 1040 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTGLDGAVFVLKGFLGVRGVPQRCHRAGLLAPCQLPVPVLTAPTPPAKAEPHTRSTCISSTDSPAQMPLFTLASLSGCPRRSSRPTPTAGLTVFSGRSLADAPWPGGEPPVTFLRTEEGPDATFPRTIPLIQQLLNATELTQDPAAYSQLVAVLVYTAERAKFATGVERQDWMELFIDTFKLVHRDIVGDPETALALC

SEQ ID NO: 842775 - protein, 942 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTDAPWPGGEPPVTFLRTEEGPDATFPRTIPLIQQLLNATELTQDPAAYSQLVAVLVYTAERAKFATGVERQDWMELFIDTFKLVHRDIVGDPETALALC

SEQ ID NO: 842776 - protein, 858 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPACPLLRLHLPVSPPSSCGRSLYKNPGH

SEQ ID NO: 842777 - protein, 471 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPPRSPGPRPAPGLPRPSAGCPASLPLQPSQGS

SEQ ID NO: 842778 - protein, 513 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEIGADGRKGAPGLAWQERDRLAQKGQLGRIATSWLPGRPWKPGPRQGYPRGSSAKLPGDASDDQTAATGDPWPPRTQTAPRDASRGHGTQGAINGPPLAPPGKILAVAKEPNGRAWGPAGPQQAEPQQPGEHPGTQRPSQADDGPHTATRPVLGLTRPAHCQEKRHLGPRATRPAPTTA

SEQ ID NO: 842779 - protein, 287 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGEVSGASLPASAGRQLTQQR

SEQ ID NO: 842780 - protein, 425 aa, Homo sapiens [sequence omitted]

SEQ ID NO: 842781 - protein, 96 aa, Homo sapiens
ASDVNMNVLTTLSGDRPAVFHEKDYDSLAQPGFFDRFSGRHAELSFVFLTDGVTGNDSLHESAHSMRKQNVVPTVLALGSDVDMDVRVVSPPRPWC

SEQ ID NO: 842782 - protein, 353 aa, Homo sapiens
CPGTPRPGPCCGNSSGAPGGLPCLPCALQECDVMTYVRETCGCCGEALPTAGSGPMHRVEGGSAAGLGHRWVLHVHVTLGSEVSPVPPDDPATPPDCEKRCGALDVVFVIDSSESIGYTNFTLEKNFVINVVNRLGAIAKDPKSETGQRGRAGAALRGAGRGVGGDEMGEVQTRPSNEGLCMAGDAPDPEASGNDLTLRLAGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPG

SEQ ID NO: 842783 - protein, 227 aa, Homo sapiens
MEGHRCGAGTCPVLPTSPPPSPHLQSPHKLSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 842784 - protein, 132 aa, Homo sapiens [sequence omitted]

SEQ ID NO: 842785 - protein, 1043 aa, Homo sapiens; identical to SEQ ID NO: 842765

SEQ ID NO: 842786 - protein, 1010 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 842787 - protein, 238 aa, Homo sapiens
LSRDPPCWPHLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 842788 - protein, 216 aa, Homo sapiens
MVNLEDPERVMRLGTGQEAPCKHLDLELGQGAGVGERVMRLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 842789 - protein, 1043 aa, Homo sapiens; identical to SEQ ID NO: 842765

SEQ ID NO: 842790 - protein, 942 aa, Homo sapiens; identical to SEQ ID NO: 842775

SEQ ID NO: 842791 - protein, 943 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPRGGSRDKLRLQSLGRRVLAGRGVQPRPLADNLPG

SEQ ID NO: 842792 - protein, 850 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPGPLLKPGHPPSRAGPSLPH

SEQ ID NO: 842793 - protein, 832 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPG

SEQ ID NO: 842794 - protein, 311 aa, Homo sapiens
HVAATCSGAEPPRDQDFRATGAAKMLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQSP

SEQ ID NO: 842795 - protein, 54 aa, Homo sapiens
MQRTICAHTCTGSRGCLHDGHPREKGPSYGKSTSLQPLQLPGRSPWQEQRAEPP

SEQ ID NO: 842796 - protein, 102 aa, Homo sapiens
MAEISITLVCNMLSAAFLFLESIYRHIVGCDDGIVAMLKGPYLFLNDFEIQCTYHTTHPRTLKMYSSVISSCKVHESPRPSSLLTPTASLGVPVTTFRVRVR

SEQ ID NO: 842797 - protein, 102 aa, Homo sapiens; identical to SEQ ID NO: 842796

SEQ ID NO: 842798 - protein, 56 aa, Homo sapiens
MTLLPSKGGEQSLLKSIPLPFPSLRRPERRMDRIWALDLGKFAMYCVILHSPIYKM

SEQ ID NO: 842799 - protein, 189 aa, Homo sapiens
MVSRTERGRPAHALRPFAEATTVQACPAPYLSRLCAGLVVKDPSIYDTLESVRSCLYGAGLLPGSLPFGPLLAVPGRPRGGARRARGDADDAVYHTCFFGDSEPPALPPPPPPARAFGPGPAETPAVGPGPGPRAALSRSASVRCAGPGGGGGGGAPGALWTEAREQALCGPGLRKTKYRSFRRRLLKF

SEQ ID NO: 842800 - protein, 189 aa, Homo sapiens; identical to SEQ ID NO: 842799

SEQ ID NO: 842801 - protein, 237 aa, Homo sapiens
MTLLPSKGGDTIASVNGLNVEGIRHREIVDIIKASGNVLRLETLYGTSIRKAELEARLQYLKQTLYEKWGEYRSLMVQEQRLVHGLVVKDPSIYDTLESVRSCLYGAGLLPGSLPFGPLLAVPGRPRGGARRARGDADDAVYHTCFFGDSEPPALPPPPPPARAFGPGPAETPAVGPGPGPRAALSRSASVRCAGPGGGGGGGAPGALWTEAREQALCGPGLRKTKYRSFRRRLLKF

SEQ ID NO: 842802 - protein, 339 aa, Homo sapiens
RTRSTVSVRRGQGMVLLCGPPPHSGELSYAWIFNEYPSYQDNRRFVSQETGNLYIAKVEKSDVGNYTCVVTNTVTNHKVLGPPTPLILRNDGVMGEYEPKIEVQFPETVPTAKGATVKLECFALGNPVPTIIWRRADGKPIARKARRHKSNGILEIPNFQQEDAGLYECVAENSRGKNVARGQLTFYAQPNWIQKINDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENESVHQGFGSGSAPL

SEQ ID NO: 842803 - protein, 469 aa, Homo sapiens
RTRSTVSVRRGQGMVLLCGPPPHSGELSYAWIFNEYPSYQDNRRFVSQETGNLYIAKVEKSDVGNYTCVVTNTVTNHKVLGPPTPLILRNDGVMGEYEPKIEVQFPETVPTAKGATVKLECFALGNPVPTIIWRRADGKPIARKARRHKSNGILEIPNFQQEDAGLYECVAENSRGKNVARGQLTFYAQPNWIQKINDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGQDSAGDLMIRNIQLKHAGKYVCMVQTSVDRLSAAADLIVRG

SEQ ID NO: 842804 - protein, 384 aa, Homo sapiens
RTRSTVSVRRGQGMVLLCGPPPHSGELSYAWIFNEYPSYQDNRRFVSQETGNLYIAKVEKSDVGNYTCVVTNTVTNHKVLGPPTPLILRNDGVMGEYEPKIEVQFPETVPTAKGATVKLECFALGNPVPTIIWRRADGKPIARKARRHKSNGILEIPNFQQEDAGLYECVAENSRGKNVARGQLTFYAQPNWIQKINDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKELHPGCIQSISTSVS

SEQ ID NO: 842805 - protein, 826 aa, Homo sapiens
VLPSYLQDRCLPGVLASPELRSYPYAFSVARPLTSDSKLVSLEVNRLPCTSPSGSTTTQPAPDGVPGPLADTSLVTASAKVLPTPQPLLPAPSGSSAPPHPAKMPSGTEQQTEGTSVTFSPLKSPPQLEREMASPPECSEMPLDLSSKSNRQKLPLPNQRKTPPMPVLTPVHTSSKALLSTVLSRSQRTTQAAGGNVTSCLGSTSSPFVIFPEIVRNGDPSTWVKNSTALISTIPGTYVGVANPVPASLLLNKDPNLGLNRDPRHLPKQEPISIIDQGEPKGTGATCGKKGSQAGAEGQPSTVKRYTPARIAPGLPGCQTKELSLWKPTGPANIYPRCSVNGKPTSTQVLPVGWSPYHQASLLSIGISSAGQLTPSQGAPIRPTSVVSEFSGVPSLSSSEAVHGLPEGQPRPGGSFVPEQDPVTKNKTCRIAAKPYEEQVNPVLLTLSPQTGTLALSVQPSGGDIRMNQGPEESESHLCSDSTPKMEGPQGACGLKLAGDTKPKNQVLATYMSHELVLATPQNLPKMPELPLLPHDSHPKELILDVVPSSRRGSSTERPQLGSQVDLGRVKMEKVDGDVVFNLATCFRADGLPVAPQRGQAEVRAKAGQARVKQESVGVFACKNKWQPDDVTESLPPKKMKCGKEKDSEEQQLQPQAKAVVRSSHRPKCRKLPSDPQESTKKSPRGASDSGKEHNGVRGKHKHRKPTKPESQSPGKRADSHEEGSLEKKAKSSFRDFIPVVLSTRTRSQSDLKARKQKTSSSQSLEHRLRNRNLLLPNKVQGISDSPNGFLPNNLEEPACLENSEKPSGKRKCKTKHMATVSEEAK

SEQ ID NO: 842806 - protein, 229 aa, Homo sapiens
MISTAPLYSGVHNWTSSDRIRMCGINEERRAPLSDEESTTGDCQHFGSQEFCVSSSFSKVELTAVGSGSNARGADPDGSATEKLGHKSEDKPDDPQPKMDYAGNVAEAEGLLVPLSSPGDGLKLPASDSAEASNSRADCSWTPLNTQMSKQVDCSPAGVKALDSRQGVGEKNTFILATLGTGVPVEGTLPLVTTNFSPLPAPICPPAPGSASVPHSVPDAFQVPLSVPA

SEQ ID NO: 842807 - protein, 229 aa, Homo sapiens; identical to SEQ ID NO: 842806

SEQ ID NO: 842808 - protein, 253 aa, Homo sapiens
MISTAPLYSGVHNWTSSDRIRMCGINEERRAPLSDEESTTGDCQHFGSQEFCVSSSFSKCRKLPSDPQESTKKSPRGASDSGKEHNGVRGKHKHRKPTKPESQSPGKRADSHEEGSLEKKAKSSFRDFIPVVLSTRTRSQSGSICSSFAGMADSDMGSQEVFPTEEEEEVTPTPAKRRKVRKTQRDTQYRSHHAQDKSLLSQGRRHLWRAREMPWRTEAARQMWDTNEEEEEEEEEGLLKRKKRRRQKSRKYQ

SEQ ID NO: 842809 - protein, 217 aa, Homo sapiens
LKSWASCPFSGCIFHARRAPLSDEESTTGDCQHFGSQEFCVSSSFSKVELTAVGSGSNARGADPDGSATEKLGHKSEDKPDDPQPKMDYAGNVAEAEGLLVPLSSPGDGLKLPASDSAEASNSRADCSWTPLNTQMSKQVDCSPAGVKALDSRQGVGEKNTFILATLGTGVPVEGTLPLVTTNFSPLPAPICPPAPGSASVPHSVPDAFQVPLSVPA

SEQ ID NO: 842810 - protein, 188 aa, Homo sapiens
MYPANTLYSYVKNSHTNEHAIVQQKHYDEYGIFNSHIDHCLTGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKVPLEI

SEQ ID NO: 842811 - protein, 721 aa, Homo sapiens
CLSYCRSRRGIRRVEPLRRARARVGPRFRPLCRMEIIRSNFKSNLHKVYQAIEEADFFAIDGEFSGISDGPSVSALTNGFDTPEERYQKLKKVYKKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLECNGVISAHRNLCLSGSSDSPVSASQVAGITESRSVARLESNGAISTHCNFCLLGSSDSPVSASQVAGIYRLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 842812 - protein, 127 aa, Homo sapiens [sequence omitted]

SEQ ID NO: 842813 - protein, 102 aa, Homo sapiens
QAGTVRNFRDIGSEEGAFSSLEASRRTALPHSLKFLTHGNQDLRAANRWCCRCEQEPAGTFGSRTVFNLIKCGMGGVGNQVVSWGGENRFYFCGCGFFPFLI

SEQ ID NO: 842814 - protein, 436 aa, Homo sapiens
CLSYCRSRRGIRRVEPLRRARARVGPRFRPLCRMEIIRSNFKSNLHKVYQAIEEADFFAIDGEFSGISDGPSVSALTNGFDTPEERYQKLKKVYKKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKVPLEI

SEQ ID NO: 842815 - protein, 672 aa, Homo sapiens
CLSYCRSRRGIRRVEPLRRARARVGPRFRPLCRMEIIRSNFKSNLHKVYQAIEEADFFAIDGEFSGISDGPSVSALTNGFDTPEERYQKLKKHSMDFLLFQFGLCTFKYDYTDSKYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 842816 - protein, 649 aa, Homo sapiens
CLSYCRSRRGIRRVEPLRRARARVGPRFRPLCRMEIIRSNFKSNLHKVYQAIEEADFFAIDGEFSGISDGPSVSALTNGFDTPEERYQKLKKVYKKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 842817 - protein, 212 aa, Homo sapiens [sequence omitted]

SEQ ID NO: 842818 - protein, 519 aa, Homo sapiens
MVLTLQKRGIRSLKRYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEFLTHGNQDLRAANRWCCRCEQEPAGTFGSRTVFNLIKCGMGGVGNQVVSWGGENRFYFCGCGFFPFLI

SEQ ID NO: 842819 - protein, 649 aa, Homo sapiens; identical to SEQ ID NO: 842816

SEQ ID NO: 842820 - protein, 649 aa, Homo sapiens; identical to SEQ ID NO: 842816

SEQ ID NO: 842821 - protein, 344 aa, Homo sapiens
MVLTLQKRGIRSLKRYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLRHLQSGTELD

SEQ ID NO: 842822 - protein, 108 aa, Homo sapiens
RGWHPGRGSDSGGRPTPPWLEELGAPARWPLAREDLSQVCASWETPSPASSILGGEWSLSDPGECSGTPVLAVGGGGKRERFRISSHQQKMDSLFSRVSLFMFWRRHL

SEQ ID NO: 842823 - protein, 727 aa, Homo sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVHVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 842824 - protein, 601 aa, Homo sapiens
MKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVHVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 842825 - protein, 629 aa, Homo sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVHVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYL

SEQ ID NO: 842826 - protein, 732 aa, Homo sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVHVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMLWRIVSLGSKSTANKHRNDKSPCNNQR

SEQ ID NO: 842827 - protein, 658 aa, Homo sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVHVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLEVIFFG

SEQ ID NO: 842828 - protein, 727 aa, Homo sapiens; identical to SEQ ID NO: 842823

SEQ ID NO: 842829 - protein, 727 aa, Homo sapiens; identical to SEQ ID NO: 842823

SEQ ID NO: 842830 - protein, 709 aa, Homo sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVHVSGARCKDVLTGQEFDVRAKCVINATGPFTDSVRKMDDKDAAAICQPSAGVHIVMPGYYSPESMGLLDPATSDGRVIFFLPWPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 842831 - protein, 755 aa, Homo sapiens
MSGTNLDGNDEFDEQLRMQELYGDGKDGDTQTDAGGEPDSLGQQPTDTPYEWDLDKKAWFPKITEDFIATYQANYGFSNDGASSSTANVEDVHARTAEEPPQEKAPEPTDARKKGEKRKAESGWFHVEEDRNTNVYVSGLPPDITVDEFIQLMSKFGIIMRDPQTEEFKVKLYKDNQGNLKGDGLCCYLKRESVELALKLLDEDEIRGYKLHVEVAKFQLKGEYDASKKKKKCKDYKKKLSMQQKQLDWRPERRAGPSRMRHERVVIIKNMFHPMDFEDDPLVLNEIREDLRVECSKFGQIRKLLLFDRHPDGVASVSFRDPEEADYCIQTLDGRWFGGRQITAQAWDGTTDYQVEETSREREERLRGWEAFLNAPEANRGLRRSDSVSASERAGPSRARHFSEHPSTSKMNAQETATGMAFEEPIDEKKFEKTEDGGEFEEGASENNAKESSPEKEAEEGCPEKESEEGCPKRGFEGSCSQKESEEGNPVRGSEEDSPKKESKKKTLKNDCEENGLAKESEDDLNKESEEEVGPTKESEEDDSEKESDEDCSEKQSEDGSEREFEENGLEKDLDEEGSEKELHENVLDKELEENDSENSEFEDDGSEKVLDEEGSEREFDEDSDEKEEEEDTYEKVFDDESDEKEDEEYADEKGLEAADKKAEEGDADEKLFEESDDKEDEDADGKEVEDADEKLFEDDDSNEKLFDEEEDSSEKLFDDSDERGTLGGFGSVEEGPLSTGSSFILSSDDDDDDI

SEQ ID NO: 842832 - protein, 755 aa, Homo sapiens; identical to SEQ ID NO: 842831

SEQ ID NO: 842833 - protein, 755 aa, Homo sapiens; identical to SEQ ID NO: 842831

SEQ ID NO: 842834 - protein, 755 aa, Homo sapiens; identical to SEQ ID NO: 842831

SEQ ID NO: 842835 - protein, 755 aa, Homo sapiens; identical to SEQ ID NO: 842831

SEQ ID NO: 842836 - protein, 755 aa, Homo sapiens; identical to SEQ ID NO: 842831

SEQ ID NO: 842837 - protein, 258 aa, Homo sapiens
MSGTNLDGNDEFDEQLRMQELYGDGKDGDTQTDAGGEPDSLGQQPTDTPYEWDLDKKAWFPKITEDFIATYQANYGFSNDGASSSTANVEDVHARTAEEPPQEKAPEPTDARKKGEKRKAESGWFHVEEDRNTNVYVSGLPPDITVDEFIQLMSKFGIIMRDPQTEEFKVKLYKDNQGNLKGDGLCCYLKRESVELALKLLDEDEIRGYKLHVEVAKFQLKGEYDASKKKKKCKDYKKKLSMQQKFVIFFPFERFHIF

SEQ ID NO: 842838 - protein, 755 aa, Homo sapiens; identical to SEQ ID NO: 842831

SEQ ID NO: 842839 - protein, 744 aa, Homo sapiens
MSGTNLDGNDEFDEQLRMQELYGDGKDGDTQTDAGGEPDSLGQQPTDTPYEWDLDKKAWFPKITEDFIATYQANYGFSNDGASSSTANVEDVHARTAEEPPQEKAPEPTDARKKGEKRKAESGWFHVEEDRNTNVYVSGLPPDITVDEFIQLMSKFGIIMRDPQTEEFKVKLYKDNQGNLKGDGLCCYLKRESVELALKLLDEDEIRGYKLHVEVAKFQLKGEYDASKKKKKCKDYKKKLSMQQKQLDWRPERRAGPSRMRHERVVIIKNMFHPMDFEDDPLVLNEIREDLRVECSKFGQIRKLLLFDRHPDGVASVSFRDPEEADYCIQTLDGRWFGGRQITAQAWDGTTDYQVEETSREREERLRGWEAFLNAPEANRGLRRSDSVSASERAGPSRARHFSEHPSTSKMNAQETATGMAFEEPIDEKKFEKTEDGGEFEEGASENNAKESSPEKEAEEGCPEKESEEGCPKRGFEGSCSQKESEEGNPVRGSEEDSPKKESKKKTLKNDCEENGLAKESEDDLNKESEEEVGPTKESEEDDSEKESDEDCSEKQSEDGSEREFEENGLEKDLDEEGSEKELHENVLDKELEENDSENSEFEDDGSEKVLDEEGSEREFDEDSDEKEEEEDTYEKVFDDESDEKEDEEYADEKGLEAADKKAEEGDADEKLFEESDDKEDEDADGKEVEDADEKLFEEEDSSEKLFDDSDERGTLGGFGSVEEGPLSTGSSFILSSDDDDDDI

SEQ ID NO: 842840 - protein, 496 aa, Homo sapiens [sequence omitted]

SEQ ID NO: 842841 - protein, 88 aa, Homo sapiens
SLEDPHTLSDDKEDEDADGKEVEDADEKLFEDDDSNEKLFDEEEDSSEKLFDDSDERGTLGGFGSVEEGPLSTGSSFILSSDDDDDDI

SEQ ID NO: 842842 - protein, 90 aa, Homo sapiens
METWRKGSFRNASFFKQLSLGRPRRLRRQSSVLSQASTAGGDHEEYSNREVIRELQGRPDGRRLPLWGDEQPRAPLLAPPKPPRLYRESS

SEQ ID NO: 842843 - protein, 802 aa, Homo sapiens
DDTLNKKTSPGVKSCESSVCGEVFVGHSSLNRHIRADTAHKPSEYQEYGQEPYKCQQRKKAFRCHPSFQMQEKAHTGEKLYDCKECGKTFISHSSIQRHMIMHNGDGTYKCKFCGKACPCLSIYLIHERVHTGEKPYKCKQCGKAFSYSTSLQIHERTHTGEKPYECKECGKAFGSPNSLYEHRRTHTGEKPYECKQCGKAFRWFHSFQIHERTHSEEKAYECTKCGKAFKCPSYLCRHEVTHSGKKPCECKQCGKALSYLNFQRHMKMHTRMRPYKCKTVEKPLILPVRFEDMKELTLERNLMNASTVVKPSIVPVPFTIMKGLTLERNPMNVSSVVKPSFLPLPFDIMKGLTLERNRMSVSNVGKPSDLPHTFKCMEGLTLKRNPMNVSSVVKPSFFPLPFDIMKGLTLERNPMSVSNVGKPSHLPHTFKCMKGLTLESNCMNLNNVKKPLDLSETFKFMKRHTLERNPIRNMEKHSTISLPFKYMQQCTEDRMPMNVKSVTKHSYLPRSFEYMQEHTLERNPMNVRNAEKRSIIFLLCVYTKGCTLERNHINVRIVGKHSVCLVPFVDIKGLTLELKPYECKECGKAFTSSGSFQCHKRIHTGEKPYECKQCGKAFISSTAIRRHERTHTGEKPYECKQCGKAFISFSSIQYHERTHTGEKQYECKQCGKAFMSSTAFQYHEKTHTREKHYECKQCGKAFISSGSLRYHERTHTGEKPYECKQCGKAFRSATQLQMHRKIHTGEKPYECKQCGKAYRSVSQLLVHERTHTVEQPYEYKQYGKAFRFAKNLQIQTMNVNN

SEQ ID NO: 842844 - protein, 31 aa, Homo sapiens
MSAGKGETLTTSSSRNSKEGKEGYLQLRGNT

SEQ ID NO: 842845 - protein, 235 aa, Homo sapiens
LRPLDILAEVVPSDGATSGIRIVQVHGARGLQLSVAAPRTMSFPASRIFSQCDLFPEEFSIVVTLRVPNLPPKRNEYLLTVVAEESDLLLLGLRLSPAQLHFLFLREDTAGAWQTRVSFRSPALVDGRWHTLVLAVSAGVFSLTTDCGLPVDIMADVPFPATLSVKGARFFVGSRRRAKGLFMGLVRQLVLLPGSDATPRLCPSRNAPLAVLSIPRVLQALTGKPEDNEVLKYPY

SEQ ID NO: 842846 - protein, 130 aa, Homo sapiens
SPTSFSHNCVARVAGPMAPNYPQILIPASLLGPPWLPLGQLTLKVQLGSELLQEAFPSPALLGDLFLLHTYLSHFCGRLFFILRLQLRHPSPARPQQLLQSFPRSLLLSLPAPSVTWSTSLSQQLVSSTT

SEQ ID NO: 842847 - protein, 111 aa, Homo sapiens [sequence omitted]

SEQ ID NO: 842848 - protein, 164 aa, Homo sapiens
EQCPFHGWAHSWHQLSWSNGNPIYCTRDTFCGDSEMQRDQITSRKGRAWCEGTRLTDIPDDQPVGPSGSLPPASHSGEGPVIEAVGIPEERTQQKQVEGVGQRADLPPATLSYCSSRGNNLGGCHEGFSGAPCPWGLMEGGNCVNVVWWKKQAWSAHRLGVPRI

SEQ ID NO: 842849 - protein, 175 aa, Homo sapiens
MGKVLSKIFGNKEMRILMLGLDAAGKTTILYKLKLGQSVTTIPTVGFNVETVTYKNVKFNVWDVGGQDKIRPLWRHYYTGTQGLIFVVDCADRDRIDEARQELHRIINDREMRDAIILIFANKQDLPDAMKPHEIQEKLGLTRIRDRNWYVQPSCATSGDGLYEGLTWLTSNYKS

SEQ ID NO: 842850 - protein, 175 aa, Homo sapiens; identical to SEQ ID NO: 842849

SEQ ID NO: 842851 - protein, 175 aa, Homo sapiens; identical to SEQ ID NO: 842849

SEQ ID NO: 842852 - protein, 175 aa, Homo sapiens; identical to SEQ ID NO: 842849

SEQ ID NO: 842853 - protein, 175 aa, Homo sapiens; identical to SEQ ID NO: 842849

SEQ ID NO: 842854 - protein, 175 aa, Homo sapiens; identical to SEQ ID NO: 842849

SEQ ID NO: 842855 - protein, 175 aa, Homo sapiens; identical to SEQ ID NO: 842849

SEQ ID NO: 842856 - protein, 175 aa, Homo sapiens; identical to SEQ ID NO: 842849

SEQ ID NO: 842857 - protein, 175 aa, Homo sapiens; identical to SEQ ID NO: 842849

SEQ ID NO: 842858 - protein, 175 aa, Homo sapiens; identical to SEQ ID NO: 842849

SEQ ID NO: 842859 - protein, 153 aa, Homo sapiens
KSFFLFFILWKTKAEKLKPQTPEKILKNMFFLKKYCMSLLLSLPPNSPSCVLSFLSALSPPHIHALLREGNLSLGPRIPLASKNPFPSSRFLHSQEQVSPRNHLPSLRMCASAQPPTLTFLPQTPHPPILLGQRALFPRSPGAPASWPPRLRG

SEQ ID NO: 842860 - protein, 133 aa, Homo sapiens
MSEAENEFINWVATAAIEANCSQCWLCVELPEAAGNGLPWRIVPANISEWICQYQWEWDNTWFCFDFLSQSVSLSPRLECSGTILAQCNLCLLGSSDSPASASQVAGIIGACRHAWLIFCIFSRDGVSPYCPG

SEQ ID NO: 842861 - protein, 290 aa, Homo sapiens
MRDQPVPRLSVPAALALGSAALGAAFATGLFLGRRCPPWRGRREQCLLPPEDSRLWQYLLSRSMREHPALRSLRLLTLEQPQGDSMMTCEQAQLLANLARLIQAKKALDLGTFTGYSALALALALPADGRVVTCEVDAQPPELGRPLWRQAEAEHKIDLRLKPALETLDELLAAGEAGTFDVAVVDADKENCSAYYERCLQLLRPGGILAVLRLLVTSCRALPSGGPAPARNYLRKPAFVWNSFQDPEDYQTEHNTIHNEPGLDRQLQQNPADQASTTPTTEGRYTRSSH

SEQ ID NO: 842862 - protein, 275 aa, Homo sapiens
VTCHCLPPPPARAMTQPVPRLSVPAALALGSAALGAAFATGLFLGRRCPPWRGRREQCLLPPEDSRLWQYLLSRSMREHPALRSLRLLTLEQPQGDSMMTCEQAQLLANLARLIQAKKALDLGTFTGYSALALALALPADGRVVTCEVDAQPPELGRPLWRQAEAEHKIDLRLKPALETLDELLAAGEAGTFDVAVVDADKENCSAYYERCLQLLRPGGILAVLRVLWRGKVLQPPKGDVAAECVRNLNERIRRDVRVYISLLPLGDGLTLAFKI

SEQ ID NO: 842863 - protein, 304 aa, Homo sapiens
VTCHCLPPPPARAMTQPVPRLSVPAALALGSAALGAAFATGLFLGRRCPPWRGRREQCLLPPEDSRLWQYLLSRSMREHPALRSLRLLTLEQPQGDSMMTCEQAQLLANLARLIQAKKALDLGRGTRPGSRRAEVSGPTPTLGWPVCVLVPGTFTGYSALALALALPADGRVVTCEVDAQPPELGRPLWRQAEAEHKIDLRLKPALETLDELLAAGEAGTFDVAVVDADKENCSAYYERCLQLLRPGGILAVLRVLWRGKVLQPPKGDVAAECVRNLNERIRRDVRVYISLLPLGDGLTLAFKI

SEQ ID NO: 842864 - protein, 115 aa, Homo sapiens
MGPQGRGGRGLSAPALPPPEDELLAAGEAGTFDVAVVDADKENCSAYYERCLQLLRPGGILAVLRVLWRGKVLQPPKGDVAAECVRNLNERIRRDVRVYISLLPLGDGLTLAFKI

SEQ ID NO: 842865 - protein, 275 aa, Homo sapiens; identical to SEQ ID NO: 842862

SEQ ID NO: 842866 - protein, 178 aa, Homo sapiens [sequence omitted]

SEQ ID NO: 842867 - protein, 367 aa, Homo sapiens
MRDQPVPRLSVPAALALGSAALGAAFATGLFLGRRCPPWRGRREQCLLPPEDSRLWQYLLSRSMREHPALRSLRLVSRARDGNGRPSRPLRVPRGCVTLGWALALPGLPASLGRVRWALPKGQSPRPRPEPRPWGLGPPGRRWVTCMAGATLSFHAADPGAAAGGFYDDLRAGPALGQPGAAHPGQEGAGPGHLHGLLRPGPGPGAARGRARGDLRGGRAAPGAGTAPVEAGERPRLALQPQAGAQRLTRSLPQAEAEHKIDLRLKPALETLDELLAAGEAGTFDVAVVDADKENCSAYYERCLQLLRPGGILAVLRVLWRGKVLQPPKGDVAAECVRNLNERIRRDVRVYISLLPLGDGLTLAFKI

SEQ ID NO: 842868 - protein, 97 aa, Homo sapiens
PKPRLPRPGWPRPPAGPVAREGAATSERGRGGRVCAKPKRTHPAGRQGLHQPPAPGRWTHLGLQDLGLAPSEWARGRVAWEPQELTLSFKFENKVGL

SEQ ID NO: 842869 - protein, 46 aa, Homo sapiens
MSGHGSWGHRRLLPIPSRRELLHSERVTPLTLWRSHTCNSKPPSQN

SEQ ID NO: 842870 - protein, 546 aa, Homo sapiens
RSAASPAEPRLDRGPRPGGHCCHRRRHLVSSPSPPSPRSPRLTRARGRGHSPPPLPARMPKVKALQCALALEISSVTCPGVVLKDKEDIYLSICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 842871 - protein, 529 aa, Homo sapiens
RSAASPAEPRLDRGPRPGGHCCHRRRHLVSSPSPPSPRSPRLTRARGRGHSPPPLPARMPSEGGCEYICDCKKGIICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 842872 - protein, 530 aa, Homo sapiens
RSAASPAEPRLDRGPRPGGHCCHRRRHLVSSPSPPSPRSPRLTRARGRGHSPPPLPARMPKVKALQCALALEISSVTCPGVVLKDKEDIYLSICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 842873 - protein, 312 aa, Homo sapiens
RSAASPAEPRLDRGPRPGGHCCHRRRHLVSSPSPPSPRSPRLTRARGRGHSPPPLPARMPKVKALQCALALEISSVTCPGVVLKDKEDIYLSICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPLIRENPTDPSLRTAWTRCTGTYTKRPVVLLHIHRKASETIHDKPH

SEQ ID NO: 842874 - protein, 494 aa, Homo sapiens
RSAASPAEPRLDRGPRPGGHCCHRRRHLVSSPSPPSPRSPRLTRARGRGHSPPPLPARMPKVKALQCALALEISSVTCPGVVLKDKEDIYLSICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYDERDLEKDDELELKRSLLCRDSAYDSDPEYRNAPYVLI

SEQ ID NO: 842875 - protein, 307 aa, Homo sapiens
RSAASPAEPRLDRGPRPGGHCCHRRRHLVSSPSPPSPRSPRLTRARGRGHSPPPLPARMPKVKALQCALALEISSVTCPGVVLKDKEDIYLSICVFGQYKKTQCVPATFPLVFNARMVFEKKTVFLIQVPPMGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVCVLLSISI

SEQ ID NO: 842876 - protein, 263 aa, Homo sapiens
MCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 842877 - protein, 337 aa, Homo sapiens
IIEQGGEGPEAYHELQKKERWSNLMQLDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 842878 - protein, 459 aa, Homo sapiens
RSAASPAEPRLDRGPRPGGHCCHRRRHLVSSPSPPSPRSPRLTRARGRGHSPPPLPARMPKVKALQCALALEISSVTCPGVVLKDKEDIYLSICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYVSF

SEQ ID NO: 842879 - protein, 132 aa, Homo sapiens
GKDTAFTRSLGPTHDHHYIRTDISEHYWLNGAKFIGTFFIPDTYNPDDDKIYFFFRESSQEGSTSDKTILSRVGRVCKNDVGGQRSLINKWTTFLKARLICSIPGSDGADTYFDELRKFLLSFFLGKALLPN

SEQ ID NO: 842880 - protein, 269 aa, Homo sapiens
GKDTAFTRSLGPTHDHHYIRTDISEHYWLNGAKFIGTFFIPDTYNPDDDKIYFFFRESSQEGSTSDKTILSRVGRVCKNDVGGQRSLINKWTTFLKARLICSIPGSDGADTYFDELQDIYLLPTRDERNPVVYGVFTTTSSIFKGSAVCVYSMADIRAVFNGPYAHKESADHRWVQYDGRIPYPRPGTCPSKTYDPLIKSTRDFPDDVISFIKRHSVMYKSVYPVAGGPTFKRINVDYRLTQIVVDHVIAEDGQYDVMFLGTGKLKLDQ

SEQ ID NO: 842881 - protein, 241 aa, Homo sapiens
GKDTAFTRSLGPTHDHHYIRTDISEHYWLNGAKFIGTFFIPDTYNPDDDKIYFFFRESSQEGSTSDKTILSRVGRVCKNDVGGQRSLINKWTTFLKARLICSIPGSDGADTYFDELQDIYLLPTRDERNPVVYGVFTTTSSIFKGSAVCVYSMADIRAVFNGPYAHKESADHRWVQYDGRIPYPRPGTTPFSYKAQEACPVCAPGLQGPSLRWSHLQGPRTSWSRCSHHQFAKGPIKCSTT

SEQ ID NO: 842882 - protein, 132 aa, Homo sapiens; identical to SEQ ID NO: 842879

SEQ ID NO: 842883 - protein, 281 aa, Homo sapiens
MAAPALGLVCGRCPELGLVLLLLLLSLLCGAAGSQEAGTGAGAGSLAGSCGCGTPQRPGAHGNSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPV

SEQ ID NO: 842884 - protein, 256 aa, Homo sapiens
MAAPALGLVCGRCPELGLVLLLLLLSLLCGAAGSQEAGTGAGAGSLAGSCGCGTPQRPGAHGNSAAAHRYSREANAPGPVPGERQLAHSKMVPIPAGVFTMGTDDPQIKQDGEAPARRVTIDAFYMDAYEVSNTEFEKFVNSTGYLTEVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPV

SEQ ID NO: 842885 - protein, 131 aa, Homo sapiens
MLLDLTSTASILMDQLISCLMSPWVLAPWQQWLYLKISLGQTWRRRKPKNLVSEAIAAGIFNDLGSGSNIDLCVISKNKLDFLRPYTVPNKKGTRLGRYRCEKGTTAVLTEKITPLEIEVLEETVQTMDTS

SEQ ID NO: 842886 - protein, 135 aa, Homo sapiens
RTRNCFLGKMAAVSVYAPPVGGFSFDNCRRNAVLEADFAKRGYKLPKVRKTGTTIAGVVYKDGIVLGADTRATEGMVVADKNCSKIHFISPNIYCCGAGTAADTDMTTQLISSNLGAPLPLHWPSSQSCDSQVGC

SEQ ID NO: 842887 - protein, 135 aa, Homo sapiens; identical to SEQ ID NO: 842886

SEQ ID NO: 842888 - protein, 131 aa, Homo sapiens; identical to SEQ ID NO: 842885

SEQ ID NO: 842889 - protein, 117 aa, Homo sapiens
RTRNCFLGKMAAVSVYAPPVGGFSFDNCRRNAVLEADFAKRGYKLPKVRKTGTTIAGVVYKDGIVLGADTRATEGMVVADKNSADTDMTTQLISSNLGAPLPLHWPSSQSCDSQVGC

SEQ ID NO: 842890 - protein, 135 aa, Homo sapiens; identical to SEQ ID NO: 842886

SEQ ID NO: 842891 - protein, 131 aa, Homo sapiens; identical to SEQ ID NO: 842885

SEQ ID NO: 842892 - protein, 77 aa, Homo sapiens
ASSAWMRGDLQLLVPQGPDKVVPRHCKGCQWSSPGPESPVRTPGGSAQALPVGFLLLHGPPLCVFFPNLKKPLFILK

SEQ ID NO: 842893 - protein, 77 aa, Homo sapiens; identical to SEQ ID NO: 842892

SEQ ID NO: 842894 - protein, 77 aa, Homo sapiens; identical to SEQ ID NO: 842892

SEQ ID NO: 842895 - protein, 219 aa, Homo sapiens
RTRNCFLGKMAAVSVYAPPVGGFSFDNCRRNAVLEADFAKRGYKLPKVRKTGTTIAGVVYKDGIVLGADTRATEGMVVADKNCSKIHFISPNIYCCGAGTAADTDMTTQLISVLAPWQQWLYLKISLGQTWRRRKPKNLVSEAIAAGIFNDLGSGSNIDLCVISKNKLDFLRPYTVPNKKGTRLGRYRCEKGTTAVLTEKITPLEIEVLEETVQTMDTS

SEQ ID NO: 842896 - protein, 77 aa, Homo sapiens; identical to SEQ ID NO: 842892

SEQ ID NO: 842897 - protein, 135 aa, Homo sapiens; identical to SEQ ID NO: 842886

SEQ ID NO: 842898 - protein, 116 aa, Homo sapiens
TEKCTFFLQVLAPWQQWLYLKISLGQTWRRRKPKNLVSEAIAAGIFNDLGSGSNIDLCVISKNKLDFLRPYTVPNKKGTRLGRYRCEKGTTAVLTEKITPLEIEVLEETVQTMDTS

SEQ ID NO: 842899 - protein, 135 aa, Homo sapiens; identical to SEQ ID NO: 842886

SEQ ID NO: 842900 - protein, 135 aa, Homo sapiens; identical to SEQ ID NO: 842886

SEQ ID NO: 842901 - protein, 135 aa, Homo sapiens; identical to SEQ ID NO: 842886

SEQ ID NO: 842902 - protein, 131 aa, Homo sapiens; identical to SEQ ID NO: 842885

SEQ ID NO: 842903 - protein, 160 aa, Homo sapiens
MLLDLTSTASILMDQLISCLMSPWVLAPWQQWLYLKISLGQTWRRRKPKNLVSEAIAAGIFNDLGSGSNIDLCVISKNKLDFLRPYTVPNKKGTRVSEGDEVLPGSPGVVATLGISMASGWSFPGSFHIKYIQCSQINLPHRPSACYLLYDSGLLSGVGK

SEQ ID NO: 842904 - protein, 131 aa, Homo sapiens; identical to SEQ ID NO: 842885

SEQ ID NO: 842905 - protein, 77 aa, Homo sapiens; identical to SEQ ID NO: 842892

SEQ ID NO: 842906 - protein, 135 aa, Homo sapiens; identical to SEQ ID NO: 842886

SEQ ID NO: 842907 - protein, 135 aa, Homo sapiens; identical to SEQ ID NO: 842886

SEQ ID NO: 842908 - protein, 77 aa, Homo sapiens; identical to SEQ ID NO: 842892

SEQ ID NO: 842909 - protein, 208 aa, Homo sapiens
MALLRRPTVSSDLENIDTGVNSKVKSHVTIRRTVLEEIGNRVTTRAAQVAKKAQNTKVPVQPTKTTNVNKQLKPTASVKPVQMEKLAPKGPSPTPEDVSMKEENLCQAFSDALLCKIEDIDNEDWENPQLCSDYVKDIYQYLRQLEVLQSINPHFLDGRDINGRMRAILVDWLVQVHSKFRLLQETLYMCVGIMDRFLQVGVASGTSR

SEQ ID NO: 842910 - protein, 398 aa, Homo sapiens
MALLRRPTVSSDLENIDTGVNSKVKSHVTIRRTVLEEIGNRVTTRAAQVAKKAQNTKVPVQPTKTTNVNKQLKPTASVKPVQMEKLAPKGPSPTPEDVSMKEENLCQAFSDALLCKIEDIDNEDWENPQLCSDYVKDIYQYLRQLEVLQSINPHFLDGRDINGRMRAILVDWLVQVHSKFRLLQETLYMCVGIMDRFLQVQPVSRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSKVAAAASCLSQKVLGQGKWNLKQQYYTGYTENEVLEVMQHMAKNVVKVNENLTKFIAIKNKYASSKLLKISMIPQLNSKAVKDLASPLIGRS

SEQ ID NO: 842911 - protein, 398 aa, Homo sapiens; identical to SEQ ID NO: 842910

SEQ ID NO: 842912 - protein, 398 aa, Homo sapiens; identical to SEQ ID NO: 842910

SEQ ID NO: 842913 - protein, 189 aa, Homo sapiens
MALLRRPTVSSDLENIDTGVNSKVKSHVTIRRTVLEEIGNRVTTRAAQVAKKAQNTKVPVQPTKTTNVNKQLKPTASVKPVQMEKLAPKGPSPTPEDVSMKEENLCQAFSDALLCYVKDIYQYLRQLEVLQSINPHFLDGRDINGRMRAILVDWLVQVHSKFRLLQETLYMCVGIMDRFLQGHHFRRTP

SEQ ID NO: 842914 - protein, 398 aa, Homo sapiens; identical to SEQ ID NO: 842910

SEQ ID NO: 842915 - protein, 374 aa, Homo sapiens
MALLRRPTVSSDLENIDTGVNSKVKSHVTIRRTVLEEIGNRVTTRAAQVAKKAQNTKVPVQPTKTTNVNKQLKPTASVKPVQMEKLAPKGPSPTPEDVSMKEENLCQAFSDALLCKIEDIDNEDWENPQLCSDYVKDIYQYLRQLEVLQSINPHFLDGRDINGRMRAILVDWLVQVHSKFRLLQETLYMCVGIMDRFLQVQPVSRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSKVAAAASCLSQKVLGQGKWNLKQQYYTGYTENEVLEVMQHMAKNVVKVNENLTKFIVSTTVFLSCGKL

SEQ ID NO: 842916 - protein, 234 aa, Homo sapiens
MRAILVDWLVQVHSKFRLLQETLYMCVGIMDRFLQVQPVSRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSKVAAAASCLSQKVLGQGKWNLKQQYYTGYTENEVLEVMQHMAKNVVKVNENLTKFIAIKNKYASSKLLKISMIPQLNSKAVKDLASPLIGRS

SEQ ID NO: 842917 - protein, 77 aa, Homo sapiens
PIQPTVMHGSATWLTIVCVCTALSAVSHAFCAHRLNVAVSPWDATWWGNGKQNSQELRRAGLAVLWEPELLGLQAPL

SEQ ID NO: 842918 - protein, 116 aa, Homo sapiens
PTQVVQGDVISGSLKTLSPSTVTLTGSRSWDVGISFLGPPIQPTVMHGSATWLTIVCVCTALSAVSHAFCAHRLNVAVSPWDATWWGNGKQNSQELRRAGLAVLWEPELLGLQAPL

SEQ ID NO: 842919 - protein, 124 aa, Homo sapiens
MGFPLSREGSIFKLTVLAVFAHAYMPSALAASIFHPEAGPWGRHAAPTNVVENPLPETDSQPIPPSGGPFSEPQFHNGESEESHEQFLKALQNAVTTFVNRMKSNHMRGRSITNDSAVLSLFQS

SEQ ID NO: 842920 - protein, 581 aa, Homo sapiens
MSIDQQQVQPLQLQQRFPVARVWRVPETSEPADFPSREPARTPSFAGSHAPQWEGGTEKHFLEAGTPCPTQPCHYFPSDWAGAIGNRSDQRRDTHPISLGCKISISLASLNYLCTNKSDGENLAQEMQYAGHIASKGITHSCAVCILCGPSREGDSPVAMGMTRMLLECSLSDKLCVIQEKQYEVIIVPTLLVTIFLILLGVILWLFIREQRTQQQRSGPQGIAPVPPPRDLSWEAGHGGNVALPLKETSVENFLGATTPALAKLQVPREQLSEVLEQICSGSCGPIFRANMNTGDPSKPKSVILKALKEPAGLHEVQDFLGRIQFHQYLGKHKNLVQLEGCCTEKLPLYMVLEDVAQGDLLGFLWTCRRDVMTMDGLLYDLTEKQVYHIGKQVLLALEFLQEKHLFHGDVAARNILMQSDLTAKLCGLGLAYEVYTRGAISSTQTIPLKWLAPERLLLRPASIRADVWSFGILLYEMVTLGAPPYPEVPPTSILEHLQRRKIMKRPSSCTHTMYSIMKSCWRWREADRPSPRELRLRLEAAIKTADDEAVLQVPELVVPELYAAVAGIRVESLFYNYSML

SEQ ID NO: 842921 - protein, 581 aa, Homo sapiens; identical to SEQ ID NO: 842920

SEQ ID NO: 842922 - protein, 587 aa, Homo sapiens
MSIDQQQVQPLQLQQRFPVARVWRVPETSEPADFPSREPARTPSFAGSHAPQWEGGTEKHFLEAGTPCPTQPCHYFPSDWAGAIGNRSDQRRDTHPISLGCKISISLASLNYLCTNKSDGENLAQEMQYAGHIASKGITHSCAVCILCGPSREGDSPVAMGMTRMLLECSLSDKLCVIQEKQYEVIIVPTLLVTIFLILLGVILWLFIREQRTQQQRSGPQGIAPVPPPRDLSWEAGHGGNVALPLKETSVENFLGATTPALAKLQVPREQLSEVLEQICSGSCGPIFRANMNTGDPSKPKSVILKALKEPAGLHEVQDFLGRIQFHQYLGKHKNLVQLEGCCTEKLPLYMVLEDVAQGDLLGFLWTCRRVSSRAEDVMTMDGLLYDLTEKQVYHIGKQVLLALEFLQEKHLFHGDVAARNILMQSDLTAKLCGLGLAYEVYTRGAISSTQTIPLKWLAPERLLLRPASIRADVWSFGILLYEMVTLGAPPYPEVPPTSILEHLQRRKIMKRPSSCTHTMYSIMKSCWRWREADRPSPRELRLRLEAAIKTADDEAVLQVPELVVPELYAAVAGIRVESLFYNYSML

SEQ ID NO: 842923 - protein, 418 aa, Homo sapiens
MGMTRMLLECSLSDKLCVIQEKQYEVIIVPTLLVTIFLILLGVILWLFIREQRTQQQRSGPQGIAPVPPPRDLSWEAGHGGNVALPLKETSVENFLGATTPALAKLQVPREQLSEVLEQICSGSCGPIFRANMNTGDPSKPKSVILKALKEPAGLHEVQDFLGRIQFHQYLGKHKNLVQLEGCCTEKLPLYMVLEDVAQGDLLGFLWTCRRDVMTMDGLLYDLTEKQVYHIGKQVLLALEFLQEKHLFHGDVAARNILMQSDLTAKLCGLGLAYEVYTRGAISSTQTIPLKWLAPERLLLRPASIRADVWSFGILLYEMVTLGSTPYPEVLLTRSRAFQEANQKNQSWQYRQDRVCARHMTPNKRPGQGTATSALAQGDQRVGERTHKKIPKPYISRGGLATRSTSVLHRSHKNTINS

SEQ ID NO: 842924 - protein, 240 aa, Homo sapiens
MFQRLNKMFVGEVSSSSNQEPEFNEKEDDEWILVDFIDTCTGFSAEEEEEEEDISEESPTEHPSVFSCLPASLECLADTSDSCFLQFESCPMEESWFITPPPCFTAGGLTTIKVETSPMENLLIEHPSMSVYAVHNSCPGLSEATRGTDELHSPSSPRVEAQNEMGQHIHCYVAALAAHTTFLEQPKSFRPSQWIKEHSERQPLNRNSLRRQNLTRDCHPRQVKHNGWVVHQPCPRQYNY

SEQ ID NO: 842925 - protein, 164 aa, Homo sapiens
MFQRLNKMFVGEVSSSSNQEPEFNEKEDDEWILVDFIDTCTGFSAEEEEEEEDISEESPTEHPSVFSCLPASLECLADTSDSCFLQFESCPMEESWFITPPPCFTAGGLTTIKVETSPMENLLIEHPSMSVYAVHNSCPGLSEATRGTDELHSPSSPRARKSCL

SEQ ID NO: 842926 - protein, 164 aa, Homo sapiens; identical to SEQ ID NO: 842925

SEQ ID NO: 842927 - protein, 164 aa, Homo sapiens; identical to SEQ ID NO: 842925

SEQ ID NO: 842928 - protein, 164 aa, Homo sapiens; identical to SEQ ID NO: 842925

SEQ ID NO: 842929 - protein, 101 aa, Homo sapiens
NNKRTWTGRPGRTTRGLESAPRLPSGYLNEVQRSPAPPQLPQQSRPARVLPRRAGPLPSPRSPARPGPTYNDSSCFSPKLNKHPVHFNLLSVPLGQLKTRF

SEQ ID NO: 842930 - protein, 164 aa, Homo sapiens; identical to SEQ ID NO: 842925

SEQ ID NO: 842931 - protein, 163 aa, Homo sapiens
MFQRLNKMFVGEVSSSSNQEPEFNEKEDDEWILVDFIDTCTGFSAEEEEEEEDISEESPTEHPSVFSCLPASLECLADTSDSCFLQFESCPMEESWFITPPPCFTAGGLTTIKVETSPMENLLIEHPSMSVYAVHNSCPGLSEATRGTDELHSPSSPRYVTSI

SEQ ID NO: 842932 - protein, 508 aa, Homo sapiens
AQFQGSGILCLTEHCCPMAIPKHSLSPVPWEEDSFLQVKVEEEEEASLSQGGESSHDHIAHSEAARLRFRHFRYEEASGPHEALAHLRALCCQWLQPEAHSKEQILELLVLEQFLGALPPEIQAWVGAQSPKSGEEAAVLVEDLTQVLDKRGWDPGAEPTEASCKQSDLGESEPSNVTETLMGGVSLGPAFVKACEPEGSSERSGLSGEIWTKSVTQQIHFKKTSGPYKDVPTDQRGRESGASRNSSSAWPNLTSQEKPPSEDKFDLVDAYGTEPPYTYSGKRSSKCRECRKMFQSASALEAHQKTHSRKTPYACSECGKAFSRSTHLAQHQVVHTGAKPHECKECGKAFSRVTHLTQHQRIHTGEKPYKCGECGKTFSRSTHLTQHQRVHTGERPYECDACGKAFSQSTHLTQHQRIHTGEKPYKCDACGRAFSDCSALIRHLRIHSGEKPYQCKVCPKAFAQSSSLIEHQRIHTGEKPYKCSDCGKAFSRSSALMVHLRIHITVLQ

SEQ ID NO: 842933 - protein, 784 aa, Homo sapiens
VQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDGTLFVWTEVSAGTEMYSDQLKGETVHHVTDKLPASRKHLGPFCSHSVTLARNQWLCGVRDMAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLVRIEILRVRLVG

SEQ ID NO: 842934 - protein, 776 aa, Homo sapiens
VQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDEYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDGTLFVWTEVSAGTEMYSDQLKGETVHHVTDKLPASRKHLGPFCSHSVTLARNQWLCGVRDMAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLVRIEILRVRLVG

SEQ ID NO: 842935 - protein, 742 aa, Homo sapiens
VQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGTLFVWTEVSAGTEMYSDQLKGETVHHVTDKLPASRKHLGPFCSHSVTLARNQWLCGVRDMAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLVRIEILRVRLVG

SEQ ID NO: 842936 - protein, 866 aa, Homo sapiens
VQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDGTLFVWTEVSAGTEMYSDQLKGETVHHVTDKLPASRKHLGPFCSHSVTLARNQWLCGVRDMAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLSLLPEVVVLVGVTGQSVWLQLLRICRVLRSLKLLAQFRQIQIIILVLVRALKSMTFLLMLLLIFFYIFAVTGVYVFSEYTRSPRQDLEYHVFFS

SEQ ID NO: 842937 - protein, 611 aa, Homo sapiens
VQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDELLFVPAVKRFSVSFAKHPTNGRLDWETLVHENLPGLMEMDQDDRVWPRDSLFRYFELLEKLQYNLEERKKLQEFAVQALMNLEDK

SEQ ID NO: 842938 - protein, 540 aa, Homo sapiens
VQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDGTLFVWTEVSAGTEM

SEQ ID NO: 842939 - protein, 199 aa, Homo sapiens
MAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLVRIEILRVRLVG

SEQ ID NO: 842940 - protein, 220 aa, Homo sapiens
PEVSRIFSSIYFILWLLLGSIIFRSIIVAMMVTNFQNIRKELNEEMARREVQLKADMFKRQIIQRRKNMSHEALTSSHSKIEDRRGASQQRESLDLSEVSEVESNYGATEEDLITSASKTEETLSKKREYQSSSCVSSTSSSYSSSSESRFSESIGRLDWETLVHENLPGLMEMDQDDRVWPRDSLFRYFELLEKLQYNLEERKKLQEFAVQALMNLEDK

SEQ ID NO: 842941 - protein, 85 aa, Homo sapiens
PEVSRIFSSIYFILWLLLGSIIFRSIIVAMMVTNFQNIRKELNEEMARREVQLKADMFKRQIIQRRKNMSHEALTSSHSKIEDRS

SEQ ID NO: 842942 - protein, 106 aa, Homo sapiens [sequence omitted]

SEQ ID NO: 842943 - protein, 67 aa, Homo sapiens
VSLTGLLVEISLVWPTSDMRVMASESMTFLLMLLLIFFYIFAVTGVYVFSEYTRSPRQDLEYHVFFS

SEQ ID NO: 842944 - protein, 652 aa, Homo sapiens
MTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDGTLFVWTEVSAGTEMYSDQLKGETVHHVTDKLPASRKHLGPFCSHSVTLARNQWLCGVRDMAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLVRIEILRVRLVG

SEQ ID NO: 842945 - protein, 552 aa, Homo sapiens
RYLFLACGPWEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDGTLFVWTEVSAGTEMYSDQLKGETVHHVTDKLPASRKHLGPFCSHSVTLARNQWLCGVRDMAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLVRIEILRVRLVG

SEQ ID NO: 842946 - protein, 546 aa, Homo sapiens
VQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDGFEGCSMVPTIYPLETLHNAL

SEQ ID NO: 842947 - protein, 567 aa, Homo sapiens
VQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDELLFVPAVKRFSVSFAKHPTNGFEGCSMVPTIYPLETLHNAL

SEQ ID NO: 842948 - protein, 429 aa, Homo sapiens
VQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSEMTEKNKEARSCWKKKRSSPACKRRWSMDCRE

SEQ ID NO: 842949 - protein, 85 aa, Homo sapiens; identical to SEQ ID NO: 842941

SEQ ID NO: 842950 - protein, 185 aa, Homo sapiens
MCLSLSDFVADIEKNQEEEEDQDPQCPRLSPDLPEVEEQDVPQDSLDEVYLTPSLPHDLSDCQQPYNSTLYSLEDQLTCFALDEPDLSATLLCKLGPGQSEIAEELCQRLQRKERMLQDLLSDQNKEVVEDEMEIQGLLWSMRTGEQESQGSMQIPSRDDSTSSTAKEDASIPRCTLDKYQISFH

SEQ ID NO: 842951 - protein, 110 aa, Homo sapiens
GGVGRRQEDLRQALFGSLSGPVSLGVLLCARSSTMGKRDNRVAYMNPIAMARSRGPIQSSGPTIQDYLNRPRPTWEEVKEQLEKKKKGSKALAEFEEKMNEVCKKYLLKK

SEQ ID NO: 842952 - protein, 232 aa, Homo sapiens [sequence omitted]

SEQ ID NO: 842953 - protein, 281 aa, Homo sapiens
GGVGRRQEDLRQALFGSLSGPVSLGVLLCARSSTMGKRDNRVAYMNPIAMARSRGPIQSSGPTIQDYLNRPRPTWEEVKEQLEKKKKGSKALAEFEEKMNENWKKELEKHREKLLSGSESSSKKRQRKKKEKKKSGRYSSSSSSSSDSSSSSSDSEDEDKKQGKRRKKKKNRSHKSSESSMSETESDSKDSLKKKKKSKDGTEKEKDIKGLSKKRKMYSEDKPLSSESLSESEYIEEVRAKKKKSSEEREKATEKTKKKKKHKKHSKKKKKKAASSSPDSP

SEQ ID NO: 842954 - protein, 139 aa, Homo sapiens
GGVGRRQEDLRQALFGSLSGPVSLGVLLCARSSTMGKRDNRVAYMNPIAMARSRGPIQSSGPTIQDYLNRPRPTWEEVKEQLEKKKKGSKALAEFEEKMNENWKKELEKHREKLLSGSESSSKKRQRKKKEKKKSGRFF

SEQ ID NO: 842955 - protein, 145 aa, Homo sapiens
GGVGRRQEDLRQALFGSLSGPVSLGVLLCARSSTMGKRDNRVAYMNPIAMARSRGPIQSSGPTIQDYLNRPRPTWEEVKEQLEKKKKGSKALAEFEEKMNENWKKELEKHREKLLSGSESSSKKRQRKKKEKKKSGRVSKNFPFF

SEQ ID NO: 842956 - protein, 240 aa, Homo sapiens
GGVGRRQEDLRQALFGSLSGPVSLGVLLCARSSTMGKRDNRVAYMNPIAMARSRGPIQSSGPTIQDYLNRPRPTWEEVKEQLEKKKKGSKALAEFEEKMNENWKKELEKHREKLLSGSESSSKKRQRKKKEKKKSGRYSSSSSSSSDSSSSSSDSEDEDKKQGKRRKKKKNRSHKSSESSMSETESDSKDSLKKKKKSKDGTEKEKDIKGLSKKRKMYSEDKPLSSESLSESEYIEEVSI

SEQ ID NO: 842957 - protein, 281 aa, Homo sapiens; identical to SEQ ID NO: 842953

SEQ ID NO: 842958 - protein, 232 aa, Homo sapiens [sequence omitted]

SEQ ID NO: 842959 - protein, 281 aa, Homo sapiens; identical to SEQ ID NO: 842953

SEQ ID NO: 842960 - protein, 103 aa, Homo sapiens
MELRKKRILKDSAKRERCILKINLYHLSPCQNQSILRRCEQKRRKAVKNEKKQQKKQKRKRSIRNTVRRRKRRLLVQVLTHHNIKKNQDSLIKKVQCLRKFQL

SEQ ID NO: 842961 - protein, 145 aa, Homo sapiens; identical to SEQ ID NO: 842955

SEQ ID NO: 842962 - protein, 786 aa, Homo sapiens
MGLQPLEFSDCYLDSPWFRERIRAHEAELERTNKFIKELIKDGKNLIAATKSLSVAQRKFAHSLRDFKFEFIGDAVTDDERCIDASLREFSNFLKNLEEQREIMALSVTETLIKPLEKFRKEQLGAVKEEKKKFDKETEKNYSLIDKHLNLSAKKKDSHLQEADIQVEQNRQHFYELSLEYVCKLQEIQERKKFEFVEPMLSFFQGMFTFYHQGHELAKDFNHYKMELQINIQNTRNRFEGTRSEVEELMNKIRQNPKDHKRASQFTAEGYLYVQEKRPAPFGSSWVKHYCMYRKAAKKFNMIPFEHRSGGKLGDGEVFFLKECTKRHTDSIDRRFCFDIEAADRPGVSLTMQAFSEEERKQWLEALGGKEALSHSFNTAIIPRPEGNAQLDKMGFTIIRKCISAVETRGINDQGLYRVVGVSSKVQRLLSMLMDVKTCNEVDLENSADWEVKTITSALKQYLRSLPEPLMTYELHGDFIVPAKSGSPESRVNAIHFLVHKLPEKNKEMLDILVKHLTNVSNHSKQNLMTVANLGVVFGPTLMRPQEETVAALMDLKFQNIVVEILIENHEKIFRTPPDTTFPEPTCLSASPPNAPPRQSKRQGQRTKRPVAVYNLCLELEDGDNPYPSKEDTPTSSLDSLSSPSPVTTAVPGPPGPDKNHLLADGGSFGDWASTIPGQTRSSMVQWLNPQSPTTTSSNSAVTPLSPGSSPFPFSPPATVADKPPESIRSRKARAVYPCEAEHSSELSFEIGAIFEDVQTSREPGWLEGTLNGKRGLIPQNYVKLL

SEQ ID NO: 842963 - protein, 786 aa, Homo sapiens; identical to SEQ ID NO: 842962

SEQ ID NO: 842964 - protein, 88 aa, Homo sapiens
ASSVNPVRRINKSAARSEQSAMVLLSGGRVSPLMLWTGLSGCVRLPDPNARGLLLMAGMPLCSLLDYSLTHLILWVFVQVISLLTGRS

SEQ ID NO: 842965 - protein, 735 aa, Homo sapiens
MGLQPLEFSDCYLDSPWFRERIRAHEAELERTNKFIKELIKDGKNLIAATKSLSVAQRKFAHSLRDFKFEFIGDAVTDDERCIDASLREFSNFLKNLEEQREIMALSVTETLIKPLEKFRKEQLGAVKEEKKKFDKETEKNYSLIDKHLNLSAKKKDSHLQEADIQVEQNRQHFYELSLEYVCKLQEIQERKKFEFVEPMLSFFQGMFTFYHQGHELAKDFNHYKMELQINIQNTRNRFEGTRSEVEELMNKIRQNPKDHKRASQFTAEGYLYVQEKRPAPFGSSWVKHYCMYRKAAKKFNMIPFEHRSGGKLGDGEVFFLKECTKRHTDSIDRRFCFDIEAADRPGVSLTMQAFSEEERKQWLEALGGKEALSHSFNTAIIPRPEGNAQLDKMGFTIIRKCISAVETRGINDQGLYRVVGVSSKVQRLLSMLMDVKTCNEVDLENSADWEVKTITSALKQYLRSLPEPLMTYELHGDFIVPAKSGSPESRVNAIHFLVHKLPEKNKEMLDILVKHLTNVSNHSKQNLMTVANLGVVFGPTLMRPQEETVAALMDLKFQNIVVEILIENHEKIFRTPPDTTFPEPTCLSASPPNAPPRQSKRQGQRTKRPVAVYNLCLELEDGDNPYPSKEDTPTSSLDSLSSPSPVTTAVPGPPGPDKNHLLADGGSFGDWASTIIRSRKARAVYPCEAEHSSELSFEIGAIFEDVQTSREPGWLEGTLNGKRGLIPQNYVKLL

SEQ ID NO: 842966 - protein, 386 aa, Homo sapiens
LPLSLPDHAINCVRMGLDMCRAIRKLRAATGVDINMRVGVHSGSVLCGVIGLQKWQYDVWSHDVTLANHMEAGGVPGLRPRALGSYSRRPTRPTTGCHPFISSLRKAQDEYLKISPIWGLGDPRVQGGELGGTSCNTGSFLKSDIQERSLKDMRCLSVLGAMGVMGQEIGDLKALPADPYCLPPSRRVHITGATLALLAGAYAVEDAGMEHRDPYLRELGEPTYLVIDPRAEEEDEKGTAGGLLSSLEGLKMRPSLLMTRYLESWGAAKPFAHLSHGDSPVSTSTPLPEKTLASFSTQWSLDRSRTPRGLDDELDTGDAKFFQVIEQLNSQKQWKQSKDFNPLTLYFREKEMEKEYRLSAIPAFKYYEACTFLVFLSNFIIQMLVT

SEQ ID NO: 842967 - protein, 358 aa, Homo sapiens
LPLSLPDHAINCVRMGLDMCRAIRKLRAATGVDINMRVGVHSGSVLCGVIGLQKWQYDVWSHDVTLANHMEAGGVPGLRPRALGSYSRRPTRPTTGCHPFISSLRKAQDEYLKISPIWGLGDPRVQGGELGGTSCNTGSFLKSDIQERSLKDMRCLSVLGAMGVMGQEIGDLKALPADPYCLPPSRRVHITGATLALLAGAYAVEDAGMEHRDPYLRELGEPTYLVIDPRAEEEDEKGTAGGLLSSLEGLKMRPSLLMTRYLESWGAAKPFAHLSHGDSPVSTSTPLPEKTLASFSTQWSLDRSRTPRGLDDELDTGDAKFFQTVEAVEGLQPTDTVLQREGDGERVPTLCNPRLQIL

SEQ ID NO: 842968 - protein, 56 aa, Homo sapiens [sequence omitted]

SEQ ID NO: 842969 - protein, 277 aa, Homo sapiens
LPLSLPDHAINCVRMGLDMCRAIRKLRAATGVDINMRVGVHSGSVLCGVIGLQKWQYDVWSHDVTLANHMEAGGVPGRVHITGATLALLAGAYAVEDAGMEHRDPYLRELGEPTYLVIDPRAEEEDEKGTAGGLLSSLEGLKMRPSLLMTRYLESWGAAKPFAHLSHGDSPVSTSTPLPEKTLASFSTQWSLDRSRTPRGLDDELDTGDAKFFQVIEQLNSQKQWKQSKDFNPLTLYFREKEMEKEYRLSAIPAFKYYEACTFLVFLSNFIIQMLVT

SEQ ID NO: 842970 - protein, 412 aa, Homo sapiens
LPLSLPDHAINCVRMGLDMCRAIRKLRAATGVDINMRVGVHSGSVLCGVIGLQKWQYDVWSHDVTLANHMEAGGVPGLRPRALGSYSRRPTRPTTGCHPFISSLRKAQDEYLKISPIWGLGDPRVQGGELGGTSCNTGSFLKSDIQERSLKDMRCLSVLGAMGVMGQEIGDLKALPADPYCLPPSRRVHITGATLALLAGAYAVEDAGMEHRDPYLRELGEPTYLVIDPRAEEEDEKGTAGGLLSSLEGLKMRPSLLMTRYLESWGAAKPFAHLSHGDSPVSTSTPLPRKSPPAHLREDTRSLQTTIVGTSPTGSEKTLASFSTQWSLDRSRTPRGLDDELDTGDAKFFQVIEQLNSQKQWKQSKDFNPLTLYFREKEMEKEYRLSAIPAFKYYEACTFLVFLSNFIIQMLV

SEQ ID NO: 842971 - protein, 134 aa, Homo sapiens
MYHYLEHYIILVTAMLQIIVSCFRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPK

SEQ ID NO: 842972 - protein, 429 aa, Homo sapiens
MVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 842973 - protein, 429 aa, Homo sapiens; identical to SEQ ID NO: 842972

SEQ ID NO: 842974 - protein, 540 aa, Homo sapiens
MPLFATNPFDQDVEKATSEMNTAEDWGLILDICDKVGQSRTGPKDCLRSIMRRVNHKDPHVAMQALTLLGACVSNCGKIFHLEVCSRDFASEVSNVLNKGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 842975 - protein, 267 aa, Homo sapiens
MIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 842976 - protein, 540 aa, Homo sapiens; identical to SEQ ID NO: 842974

SEQ ID NO: 842977 - protein, 132 aa, Homo sapiens
MPLFATNPFDQDVEKATSEMNTAEDWGLILDICDKVGQSRTGPKDCLRSIMRRVNHKDPHVAMQALTLLGACVSNCGKIFHLEVCSRDFASEVSNVLNKCLSLSPRLEYSGVISADYSLCLPGSSDSPASAS

SEQ ID NO: 842978 - protein, 540 aa, Homo sapiens; identical to SEQ ID NO: 842974

SEQ ID NO: 842979 - protein, 478 aa, Homo sapiens
MQALTLLGACVSNCGKIFHLEVCSRDFASEVSNVLNKGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 842980 - protein, 490 aa, Homo sapiens
MRRVNHKDPHVAMQALTLLGACVSNCGKIFHLEVCSRDFASEVSNVLNKGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 842981 - protein, 443 aa, Homo sapiens
MLGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 842982 - protein, 586 aa, Homo sapiens
LLPLQSVLIYKEKATSEMNTAEDWGLILDICDKVGQSRTGPKDCLRSIMRRVNHKDPHVAMQALTLLGACVSNCGKIFHLEVCSRDFASEVSNVLNKGHPKVCEKLKALMVEWTDEFKNDPQLSLISAMIKNLKEQGVTFPAIGSQMRKLRLRMVEVTCPGTQLIVDSWNYNTGMLILSPVFFSLPESAFFVREAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 842983 - protein, 540 aa, Homo sapiens; identical to SEQ ID NO: 842974

SEQ ID NO: 842984 - protein, 361 aa, Homo sapiens
MPLFATNPFDQDVEKATSEMNTAEDWGLILDICDKVGQSRTGPKDCLRSIMRRVNHKDPHVAMQALTLLGACVSNCGKIFHLEVCSRDFASEVSNVLNKGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEGNVFTRWGPLPWMEKLGGFLGKPFQELF

SEQ ID NO: 842985 - protein, 81 aa, Homo sapiens
LLKRLCKALGSESRKAQVQTSAVPGTSCAAQSIQDVRSDDEDYEEEEEEEEEEATKGKEMDCLKNGLGAERHLIPNGQHGH

SEQ ID NO: 842986 - protein, 383 aa, Homo sapiens
MFWTFKEWFWLERFWLPPTIKWSDLEDHDGLVFVKPSHLYVTIPYAFLLLIIRRVFEKFVASPLAKSFGIKETVRKVTPNTVLENFFKHSTRQPLQTDIYGLAKKCNLTERQVERWFRSRRNQERPSRLKKFQEACWRFAFYLMITVAGIAFLYDKPWLYDLWEVWNGYPKQPLLPSQYWYYILEMSFYWSLLFRLGFDVKRKDFLAHIIHHLAAISLMSFSWCANYIRSGTLVMIVHDVADIWLESAKMFSYAGWTQTCNTLFFIFSTIFFISRLIVFPFWILYCTLILPMYHLEPFFSYIFLNLQLMILQVLHLYWGYYILKMLNRCIFMKSIQDVRSDDEDYEEEEEEEEEEATKGKEMDCLKNGLGAERHLIPNGQHGH

SEQ ID NO: 842987 - protein, 383 aa, Homo sapiens; identical to SEQ ID NO: 842986

SEQ ID NO: 842988 - protein, 226 aa, Homo sapiens
MFWTFKEWFWLERFWLPPTIKWSDLEDHDGLVFVKPSHLYVTIPYAFLLLIIRRVFEKFVASPLAKSFGIKETVRKVTPNTVLENFFKHSTRQPLQTDIYGLAKKCNLTERQVERWFRSRRNQERPSRLKKFQEACWRFAFYLMITVAGIAFLYDKPWLYDLWEVWNGYPKQPLLPSQYWYYILEMSFYWSLLFRLGFDVKRKVSVLFTKLLYQFLQKLPSPCPKF

SEQ ID NO: 842989 - protein, 383 aa, Homo sapiens; identical to SEQ ID NO: 842986

SEQ ID NO: 842990 - protein, 383 aa, Homo sapiens; identical to SEQ ID NO: 842986

SEQ ID NO: 842991 - protein, 450 aa, Homo sapiens
EQRKRVSLSRPRPVYPRTPRPGLEALSPRSPARPPPRPAPARWAAMERWPWPSGGAWLLVAARALLQLLRSDLRLGRPLLAALALLAALDWLCQRLLPPPAALAVLAAAGWIALSRLARPQRLPVATRAVLITGCDSGFGKETAKKLDSMGFTVLATVLELNSPGAIELRTCCSPRLRLLQMDLTKPGDISRVLEFTKAHTTSTGLWGLVNNAGHNEVVADAELSPVATFRSCMEVNFFGALELTKGLLPLLRSSRGRIVTVGSPAGDMPYPCLGAYGTSKAAVALLMDTFSCELLPWGVKVSIIQPGCFKTESVRNVGQWEKRKQLLLANLPQELLQAYGKDYIEHLHGQFLHSLRLAMSDLTPVVDAITDALLAARPRRRYYPGQGLGLMYFIHYYLPEGLRRRFLQAFFISHCLPRALQPGQPGTTPPQDAAQDPNLSPGPSPAVAR

SEQ ID NO: 842992 - protein, 191 aa, Homo sapiens
PTPNPSAGDMPYPCLGAYGTSKAAVALLMDTFSCELLPWGVKVSIIQPGCFKTESVRNVGQWEKRKQLLLANLPQELLQAYGKDYIEHLHGQFLHSLRLAMSDLTPVVDAITDALLAARPRRRYYPGQGLGLMYFIHYYLPEGLRRRFLQAFFISHCLPRALQPGQPGTTPPQDAAQDPNLSPGPSPAVAR

SEQ ID NO: 842993 - protein, 164 aa, Homo sapiens
RVDLEDPEALSDGVLSASSSRVCFKTESVRNVGQWEKRKQLLLANLPQELLQAYGKDYIEHLHGQFLHSLRLAMSDLTPVVDAITDALLAARPRRRYYPGQGLGLMYFIHYYLPEGLRRRFLQAFFISHCLPRALQPGQPGTTPPQDAAQDPNLSPGPSPAVAR

SEQ ID NO: 842994 - protein, 450 aa, Homo sapiens; identical to SEQ ID NO: 842991

SEQ ID NO: 842995 - protein, 359 aa, Homo sapiens
SGDRVSTGWFLAVFLQAWRPRWCDQQRAPGCRLCVSSGVPNKRCDSGFGKETAKKLDSMGFTVLATVLELNSPGAIELRTCCSPRLRLLQMDLTKPGDISRVLEFTKAHTTSTGLWGLVNNAGHNEVVADAELSPVATFRSCMEVNFFGALELTKGLLPLLRSSRGRIVTVGSPAGDMPYPCLGAYGTSKAAVALLMDTFSCELLPWGVKVSIIQPGCFKTESVRNVGQWEKRKQLLLANLPQELLQAYGKDYIEHLHGQFLHSLRLAMSDLTPVVDAITDALLAARPRRRYYPGQGLGLMYFIHYYLPEGLRRRFLQAFFISHCLPRALQPGQPGTTPPQDAAQDPNLSPGPSPAVAR

SEQ ID NO: 842996 - protein, 149 aa, Homo sapiens
MPDSDLATPSPESVRNVGQWEKRKQLLLANLPQELLQAYGKDYIEHLHGQFLHSLRLAMSDLTPVVDAITDALLAARPRRRYYPGQGLGLMYFIHYYLPEGLRRRFLQAFFISHCLPRALQPGQPGTTPPQDAAQDPNLSPGPSPAVAR

SEQ ID NO: 842997 - protein, 144 aa, Homo sapiens
AGLLSACLAPARPCSARGALSPPGIPFTASLSIGGVSKDPFPLGMAQPGVSVKSLVSSYETRVVGMAPGLPRKRGCASSPCSPRGASPIRGTSGPPPHRGLGGPGQRPSTRRGMDKTLLSLILYCHSGSGSLVGIDNKIEQAMD

SEQ ID NO: 842998 - protein, 395 aa, Homo sapiens
MSGGKKKSSFQITSVTTDYEGPGSPGASDPPTPQPPTGPPPRLPNGEPSPDPGGKGTPRNGSPPPGAPSSRFRVVKLPHGLGEPYRRGRWTCVDVYERDLEPHSFGGLLEGIRGASGGAGGRSLDSRLELASLGLGAPTPPSGLSQGPTSWLRPPPTSPGPQARSFTGGLGQLVVPSKAKAEKPPLSASSPQQRPPEPETGESAGTSRAATPLPSLRVEAEAGGSGARTPPLSRRKAVDMRLRMELGAPEEMGQVPPLDSRPSSPALYFTHDASLVHKSPDPFGAVAAQKFSLAHSMLAISGHLDSDDDSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 842999 - protein, 156 aa, Homo sapiens
MRLRMELGAPEEMGQVPPLDSRPSSPALYFTHDASLVHKSPDPFGAVAAQKFSLAHSMLAISGHLDSDDDSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 843000 - protein, 212 aa, Homo sapiens
AGLLSACLAPARPCSARGALSPPGIPFTASLSIGGVSKDPFPLGMAQPGVSVKSLVSSYETRVVGMAPGLPRKRGCASSPCSPRGASPIRGTSGPPPHRGLGGPGQRPSTRRGMDKTLLSLILYCHSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 843001 - protein, 243 aa, Homo sapiens
AGLLSACLAPARPCSARGALSPPGIPFTASLSIGGVSKDPFPLGMAQPGVSVKSLVSSYETRVVGMAPGLPRKRGCASSPCSPRGASPIRGTSGPPPHRGLGGPGQRPSTRRGMDKTLLSLILYCHRTGGCGREAVVQETSTWEGFSSPPLTFLCLSSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 843002 - protein, 395 aa, Homo sapiens; identical to SEQ ID NO: 842998

SEQ ID NO: 843003 - protein, 310 aa, Homo sapiens
MSGGKKKSSFQITSVTTDYEGPGSPGASDPPTPQPPTGPPPRLPNGEPSPDPGGKGTPRNGSPPPGAPSSRFRVVKLPHGLGEPYRRGRWTCVDVYERDLEPHSFGGLLEGIRGASGGAGGRSLDSRLELASLGLGAPTPPSGLSQGPTSWLRPPPTSPGPQARSFTGGLGQLVVPSKAKAEKPPLSASSPQQRPPEPETGESAGTSRAATPLPSLRVEAEAGGSGARTPPLSRRKAVDMRLRMELGAPEEMGQVPPLDSRPSSPALYFTHDASLVHKSPDPFGAVAAQKFSLAHSMLAISGHLDSDDDR

SEQ ID NO: 843004 - protein, 310 aa, Homo sapiens; identical to SEQ ID NO: 843003

SEQ ID NO: 843005 - protein, 143 aa, Homo sapiens
MNRVAGVRPEFWDPGEPRSGDTDPAGSRGRRLGTPTRWLPPGAEGGSAAPSHISLQTLGASEAAPRLLGGGAGFFFSGEQTFLGDAWQDEPRPPERTGQPLIAACVPRHCPWPGGPRERTARPLRRRDPQAQISGRGPRGAPT

SEQ ID NO: 843006 - protein, 395 aa, Homo sapiens; identical to SEQ ID NO: 842998

SEQ ID NO: 843007 - protein, 395 aa, Homo sapiens; identical to SEQ ID NO: 842998

SEQ ID NO: 843008 - protein, 382 aa, Homo sapiens [sequence omitted]

SEQ ID NO: 843009 - protein, 143 aa, Homo sapiens; identical to SEQ ID NO: 843005

SEQ ID NO: 843010 - protein, 230 aa, Homo sapiens
AGLLSACLAPARPCSARGALSPPGIPFTASLSIGGVSKDPFPLGMAQPGVSVKSLVSSYETRVVGMAPGLPRKRGCASSPCSPRGASPIRGTSGPPPHRGLGGPGQRPSTRRGMDKTLLSLILYCHRTGGCGREAVVQETSTWEGFSSPPLTFLCLSSGSGSLVGIDNKIEQAMVREAILVPGGPGPLKPSLCPSPVLFLTREHQLPAPPSLSLLGCWASSAPSCHHLHP

SEQ ID NO: 843011 - protein, 395 aa, Homo sapiens; identical to SEQ ID NO: 842998

SEQ ID NO: 843012 - protein, 313 aa, Homo sapiens
MSGGKKKSSFQITSVTTDYEGPGSPGASDPPTPQPPTGPPPRLPNGEPSPDPGGKGTPRNGSPPPGAPSSRFRVVKLPHGLGEPYRRGRWTCVDVYERDLEPHSFGGLLEGIRGASGGAGGRSLDSRLELASLGLGAPTPPSGLSQGPTSWLRPPPTSPGPQARSFTGGLGQLVVPSKAKAEKPPLSASSPQQRPPEPETGESAGTSRAATPLPSLRVEAEAGGSGARTPPLSRRKAVDMRLRMELGAPEEMGQVPPLDSRPSSPALYFTHDASLVHKSPDPFGAVAAQKFSLAHSMLAISGHLDSDDDSGYR

SEQ ID NO: 843013 - protein, 682 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQSQLPNPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKVSPHHCFIKFLLQPPIFKVLTCQLEFGQLTQHRKSTPSPFPQH

SEQ ID NO: 843014 - protein, 215 aa, Homo sapiens
MANNYKKIVLLKGLEVINDYHFRIVKSLLSNDLKLNPKMKEEYDKIQIADLMEEKFPGDAGLGKLIEFFKEIPTLGDLAETLKREKLKVANKIESIPVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPI

SEQ ID NO: 843015 - protein, 206 aa, Homo sapiens
MANNYKKIVLLKGLEVINDYHFRIVKSLLSNDLKLNPKMKEEYDKIQIADLMEEKFPGDAGLGKLIEFFKEIPTLGDLAETLKREKLKVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPI

SEQ ID NO: 843016 - protein, 708 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQSQLPNPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 843017 - protein, 729 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQSQLPNPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 843018 - protein, 729 aa, Homo sapiens; identical to SEQ ID NO: 843017

SEQ ID NO: 843019 - protein, 670 aa, Homo sapiens
CIETASAVGDRLYVFLFSALVGNKIESIPVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQSQLPNPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 843020 - protein, 328 aa, Homo sapiens [sequence omitted]

SEQ ID NO: 843021 - protein, 707 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQSQLPNPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVGTL

SEQ ID NO: 843022 - protein, 682 aa, Homo sapiens; identical to SEQ ID NO: 843013

SEQ ID NO: 843023 - protein, 513 aa, Homo sapiens [sequence omitted]

SEQ ID NO: 843024 - protein, 387 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQ

SEQ ID NO: 843025 - protein, 223 aa, Homo sapiens [sequence omitted]

SEQ ID NO: 843026 - protein, 121 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVPGYIATRGIYMMDLYRICAAPSFKQLSFNIRN

SEQ ID NO: 843027 - protein, 729 aa, Homo sapiens; identical to SEQ ID NO: 843017

SEQ ID NO: 843028 - protein, 148 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKKQQKQQKPFWALGASERFLN

SEQ ID NO: 843029 - protein, 673 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQSQLPNPSEASTTFPESHLRTPQMPPTTPSSSFFTKLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 843030 - protein, 729 aa, Homo sapiens; identical to SEQ ID NO: 843017

SEQ ID NO: 843031 - protein, 785 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQSQLPNPSEASTTFPESHLRTPQMPPTTPSSSFFTKKSEDTISKMNDFMRMQILKEGSHFPGPFMTSIGPAESHPHTPQMPPSTPSSSFLTTKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 843032 - protein, 387 aa, Homo sapiens [sequence omitted]

SEQ ID NO: 843033 - protein, 214 aa, Homo sapiens
MANNYKKIVLLKGLEVINDYHFRIVKSLLSNDLKLNPKMKEEYDKIQIADLMEEKFPGDAGLGKLIEFFKEIPTLGDLAETLKREKLKVKGIIPSKKTKQKEVYPATPACTPSNRLTAKGAEETLGPQVSFRKRSRLQVSQWKLCCGCSTQSVQQAVISSYVSHQVSDLSNYIIIDHLSARQQVKRFSKHNVNIHKINIIFSSPIEKDVNLRVR

SEQ ID NO: 843034 - protein, 80 aa, Homo sapiens
ASGLAVSGEWDPIPWGYVGEVGGCSCRGFLLVSSRNGGGARCGWANPGSPRTLRSARQGARACQGRRAGVNVASVGLQPR

SEQ ID NO: 843035 - protein, 80 aa, Homo sapiens; identical to SEQ ID NO: 843034

SEQ ID NO: 843036 - protein, 80 aa, Homo sapiens; identical to SEQ ID NO: 843034

SEQ ID NO: 843037 - protein, 80 aa, Homo sapiens; identical to SEQ ID NO: 843034

SEQ ID NO: 843038 - protein, 80 aa, Homo sapiens; identical to SEQ ID NO: 843034

SEQ ID NO: 843039 - protein, 80 aa, Homo sapiens; identical to SEQ ID NO: 843034

SEQ ID NO: 843040 - protein, 99 aa, Homo sapiens
MRPLTLPSGSALRVPRDPYALPLVSWAQVVPRAVLAAPIRGPLCPMLRAPTSVSVSHTLRLNVSTVPWVPVPRLASWVCSSRISCATSVLVALFPQSIR

SEQ ID NO: 843041 - protein, 36 aa, Homo sapiens
HSRFFTPSFYLTVDPPSQAPNLSAASTHPAPATQWP

SEQ ID NO: 843042 - protein, 80 aa, Homo sapiens
MTLNGLFRPIPYVTAASADEATASQQPPQAQLHRYNGLFRPSSCLPAFSPGPELSQVDLTRPSSCFFAASPGPAPASWWP

SEQ ID NO: 843043 - protein, 119 aa, Homo sapiens
LPRTWTTNGTKGALGKKPGRPEKGCATQQGNWSLEENAGRLRREKKRAGHRGETDRREPERAEREAGRNRLYKWINLVNSENCSFHRLTQSCESSSPRRHHICFYHVPQQFQCSTTSVS

SEQ ID NO: 843044 - protein, 195 aa, Homo sapiens
LFNVMATPRGRTKKKASFDHSPDSLPLRSSGRQAKKKATETTDEDEDGGSEKKYRKCEKAGCTATCPVCFASASERCAKNGYTSRWYHLSCGEHFCNECFDHYYRSHKDGYDKYTTWKKIWTSNGKTEPSPKAFMADQQLPYWVQCTKPECRKWRQLTKEIQLTPQIAKTYRCGMKPNTAIKPETSDHCSLPEDL

SEQ ID NO: 843045 - protein, 202 aa, Homo sapiens
LFNVMATPRGRTKKKASFDHSPDSLPLRSSGRQAKKKATETTDEDEDGGSEKKYRKCEKAGCTATCPVCFASASERCAKNGYTSRWYHLSCGEHFCNECFDHYYRSHKDGYDKYTTWKKIWTSNGKTEPSPKAFMADQQLPYWVQCTKPECRKWRQLTKEIQLTPQIAKTYRCGMKPNTAIKRRGFAVLPRVRPLIDSGTQL

SEQ ID NO: 843046 - protein, 88 aa, Homo sapiens
QLGPQQRALYRDVMLENYGNVASLGFPVPKPELISQLEQGKELWVLNLLGAEEPDILKSCQKDSEVGTKKELSILNQKFSEEVKTPEF

SEQ ID NO: 843047 - protein, 698 aa, Homo sapiens
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 843048 - protein, 592 aa, Homo sapiens
RARYRLHLCLNPMNVSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 843049 - protein, 680 aa, Homo sapiens
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 843050 - protein, 412 aa, Homo sapiens [sequence omitted]

SEQ ID NO: 843051 - protein, 698 aa, Homo sapiens; identical to SEQ ID NO: 843047

SEQ ID NO: 843052 - protein, 698 aa, Homo sapiens; identical to SEQ ID NO: 843047

SEQ ID NO: 843053 - protein, 698 aa, Homo sapiens; identical to SEQ ID NO: 843047

SEQ ID NO: 843054 - protein, 388 aa, Homo sapiens
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRVSSKQRSPRTEH

SEQ ID NO: 843055 - protein, 160 aa, Homo sapiens
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEV

SEQ ID NO: 843056 - protein, 698 aa, Homo sapiens; identical to SEQ ID NO: 843047

SEQ ID NO: 843057 - protein, 698 aa, Homo sapiens; identical to SEQ ID NO: 843047

SEQ ID NO: 843058 - protein, 527 aa, Homo sapiens
MVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 843059 - protein, 680 aa, Homo sapiens
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKANIKV

SEQ ID NO: 843060 - protein, 698 aa, Homo sapiens; identical to SEQ ID NO: 843047

SEQ ID NO: 843061 - protein, 316 aa, Homo sapiens [sequence omitted]

SEQ ID NO: 843062 - protein, 121 aa, Homo sapiens
RWLAGGILEFWRGVLLPWNERDIFLSQTEFSLENYQHRTMQAHELFRYFRMPELVDFRQYVRTLPTNTLMGFGAFAALTTFWYATRPKPLKPPCDLSMQSVEVAVSGGPSLPRAFSPHFPR

SEQ ID NO: 843063 - protein, 837 aa, Homo sapiens
MPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKVNAPALHTLETKSSLPMVHEQAFSSHILEPIEELSEEEKGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 843064 - protein, 216 aa, Homo sapiens
MPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQDCQNDLSYPEGPRVLHFFNSIKFERHIG

SEQ ID NO: 843065 - protein, 664 aa, Homo sapiens
MWHETSNRIPSKRTVSFVLSTGLYPISFQVHLVRDGVLTRFSVATEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKGNPLAWQAFESQPAAPAVPMNAPALHTLETKSSLPMVHGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 843066 - protein, 836 aa, Homo sapiens
MPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKGNPLAWQAFESQPAAPAVPMNAPALHTLETKSSLPMVHGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 843067 - protein, 836 aa, Homo sapiens; identical to SEQ ID NO: 843066

SEQ ID NO: 843068 - protein, 115 aa, Homo sapiens
MFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 843069 - protein, 762 aa, Homo sapiens
MPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKGNPLAWQAFESQPAAPAVPMNAPALHTLETKSSLPMVHGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKVKSLLLARYT

SEQ ID NO: 843070 - protein, 836 aa, Homo sapiens; identical to SEQ ID NO: 843066

SEQ ID NO: 843071 - protein, 836 aa, Homo sapiens; identical to SEQ ID NO: 843066

SEQ ID NO: 843072 - protein, 836 aa, Homo sapiens; identical to SEQ ID NO: 843066

SEQ ID NO: 843073 - protein, 824 aa, Homo sapiens
MPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKGNPLAWQAFESQPAAPAVPMNAPALHTLETKSSLPMVHGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGPSRKMNQAHSSRL

SEQ ID NO: 843074 - protein, 850 aa, Homo sapiens
MQFTILFESQRQSQRGTGTLKLCSHNIRQKTESRVSAKTPRPKCSRVWGLLKVSPEDLTLQRETLPDNAHVLPVLSPPSLLGRCDIFHSRKNPDRAQWLMPVIPALWEAESGRSPKIRGLTPAWPTWQNPVSTKNSQAWWTTCVVPATQEAEGGESLEPRRQRLQGAEIVPPHSPSLGNSVKLCLKKKKKKSSSLLKLPKASRNLVSFRKDAILISYFCFKNDVWQEFWYDKGDEVFHVINEVPKISGWAINLTSVSKLQPGPNADPILITMAFTYIIYFSYHNSGMWVLRPPFYKHVSENQEGEGSKSDSDSLGRAKILIQVFFFRQSHSSTQPGMRSGSGVISAHCNLRLPGSSNSPASASRVTGTTGVCHHTSLIFVFLVETGFCHVSQAVLKYLASSDPPTSASQSAGMDRLEPPCPALIQVILTSEPRPFTQHCIGLGLRELLLHHRLGVGYFLLKPGSPEQSDVERKEVMGCTRHACLEGKLNQMGANDRLCQNEDKKPFSFLLRQAKILRGPGSQDCFMNKEIRLRKSTSVWMQGKKLRLARKHKSRKGPRGREEEEEEDNSHQVKKTSAMPQCFLQPADFHRVNMRSEVAVLASVDSNVEGRGRAELQAFRQPWLDSKGPQARKVGCTRGIQEWWVHTPPWPSPPPPCLLSPVWERPWVPQARQEATMVNLAQSVCVLETVATERTDEQVTVSSCFHEVLCTGKACCLQHTHKKLISEEENKQTLDTRVGNANKHIVTTEGRNWSRYLIKTTAFSQARWLTPVIPALWEAAAGGSPEVRSLRPAWPTWQNPVSTKNIKISWAWWWTPVIPTTQEAKAGKPLQPRRQRLQRVKTGTLHSSLGD

SEQ ID NO: 843075 - protein, 433 aa, Homo sapiens
PCASRLSTQVRKPEVGALPQGPSRFPSEGREASAPGRTAGTPGAPAELGCPRGREPDAHPWDPDPAPAPRDGFLPRLQAQRADLSLPRGTGARVPARARRRGQRRGAEAARDPRRLGLAAMKSPPLLSPCLSWKRMAGIFFLPFISSGFAPRFKQEENFMLGRAHPSQPRFNWSHLTPLELKNRSVGLGTESTGRGKPHFTLEGHKFLIFGGSIHYFRVPREYWRDRLLKLKACGFNTVTTYVPWNLHEPERGKFDFSGNLDLEAFVLMAAEIGLWVILRPGPYICSEMDLGGLPSWLLQDPRLLLRTTNKSFIEAVEKYFDHLIPRVIPLQYRQAGPVIAVQVENEYGSFNKDKTYMPYLHKALLRRGIVELLLTSDGEKHVLSGHTKGVLAAINLQKLHQDTFNQLHKVQGASIDAGLLSDASQAATSSSL

SEQ ID NO: 843076 - protein, 111 aa, Homo sapiens
MGSGPGSSLEVQGFPLIREVGFLMAYSISPPQSPQPILTASQPHPPSATIFPLPSWHSPSKSTSSFGRLASAARGRLSVSSSAMMESKKAMASATSALNCEYFFGVAFCKR

SEQ ID NO: 843077 - protein, 138 aa, Homo sapiens
PRQDPLTGVESGQQALVFSASRDPLLYKHHWRVHMPPHLTHYCHSLRGRNDGAVLPLPLCPQSTGARGPLQCRLQRRNEGRTFPQADPSAHSPHFEKRVEFVIPSSLNVWHLLLGWQDVEQPLGQDLLAFSAFSSHYT

SEQ ID NO: 843078 - protein, 595 aa, Homo sapiens
LGEEQMIEQVNDEKGEQKQKQEQVQDVMLGRQGERMGLTGEPEGLNDGEWEQEDMERKAQGQGGPEQGEERKRELQVPEENRADSQDEKSQTFLGKSEEVTGKQEDHGIKEKGVPVSGQEAKEPESWDGGRLGAVGRARSREEENEHHGPSMPALIAPEDSPHCDLFPGASYLVTQIPGTQTESRAEELSPAALSPSLEPIRCSHQPISLLGSFLTEESPDKEIDQNSQQEGSRLRKGTVSSQGTEVVFASASVTPPRTPDSAPPSPAEAYPITPASVSARPPVAFPRRETSCAARAPETASAPLSMDDPSPCGTSEMCPAALYGFPSTGTSPPRPPANSTGTVQHLRSDSFPGSHRTEQTPDLVGMLLSYSHSELPQRPPKPAIYSSVTPRRDRRSGRDYSTVSASPTALSTLKQDSQESISNLERPSSPPSIQPWVSPHNPAFATESPAYGSSPSFVSMEDVRIHEPLPPPPPQRRDTHPSVVETDGHARVVVPTLKQHSHPPPLALGSGLHAPHKGPLPQASDPAVARQHRPLPSTPDSSHHAQATPRWRYNKPLPPTPDLPQPHLPPISAPGSSRIYRPLPPLPIIDPPTE

SEQ ID NO: 843079 - protein, 172 aa, Homo sapiens
HYNLDYNMHYLLVHRLYSSLGNATESPAYGSSPSFVSMEDVRIHEPLPPPPPQRRDTHPSVVETDGHARVVVPTLKQHSHPPPLALGSGLHAPHKGPLPQASDPAVARQHRPLPSTPDSSHHAQATPRWRYNKPLPPTPDLPQPHLPPISAPGSSRIYRPLPPLPIIDPPTE

SEQ ID NO: 843080 - protein, 171 aa, Homo sapiens
ALSVGGIACCLLNRSVSTGFRATESPAYGSSPSFVSMEDVRIHEPLPPPPPQRRDTHPSVVETDGHARVVVPTLKQHSHPPPLALGSGLHAPHKGPLPQASDPAVARQHRPLPSTPDSSHHAQATPRWRYNKPLPPTPDLPQPHLPPISAPGSSRIYRPLPPLPIIDPPTE

SEQ ID NO: 843081 - protein, 123 aa, Homo sapiens
MRLGPQGDGATSQITGTTQRKGTQKPGMPAKSRVFVSSVLHQTPVSSCDLECLTSWECSTGLSLILPSPYSRRICCGSNASDNIPHGECWILHARGPGPHCMFAFCKGCMAMTSYVDPAFLCK

SEQ ID NO: 843082 - protein, 109 aa, Homo sapiens
MAYQLYRNTTLGNSLQESLDELIQSQQITPQLALQVLLQFDKAINAALAQRVRNRVNFRGSLNTYRFCDNVWTFVLNDVEFREVTELIKVDKVKIVACDGKNTGSNTTE

SEQ ID NO: 843083 - protein, 95 aa, Homo sapiens
GASRPSGGVSLPGTASTSGSSAQFCGFCGGWRGGRRSRNLLPGSWRLLSAPRREAPSPQDINASLNKKNKFFLLSHGISVIQKYYFGKQSSGEPR

SEQ ID NO: 843084 - protein, 109 aa, Homo sapiens; identical to SEQ ID NO: 843082

SEQ ID NO: 843085 - protein, 109 aa, Homo sapiens; identical to SEQ ID NO: 843082

SEQ ID NO: 843086 - protein, 109 aa, Homo sapiens; identical to SEQ ID NO: 843082

SEQ ID NO: 843087 - protein, 94 aa, Homo sapiens
RSAYALSPQSQQITPQLALQVLLQFDKAINAALAQRVRNRVNFRGSLNTYRFCDNVWTFVLNDVEFREVTELIKVDKVKIVACDGKNTGSNTTE

SEQ ID NO: 843088 - protein, 109 aa, Homo sapiens; identical to SEQ ID NO: 843082

SEQ ID NO: 843089 - protein, 95 aa, Homo sapiens; identical to SEQ ID NO: 843083

SEQ ID NO: 843090 - protein, 157 aa, Homo sapiens
MKNHNFFLRTKVVAFLRTFFNKLILKHVKKSKRHDKREKGTAAGRKAQDGEPKGGEQDRREREGDQRRAEKKAAGRREGARRGGRASTETTQIHATQNGERKDKSREKKTPSRCGEPTETTTECRKIERESIAETQRKRDTGREKSGDHENTKQHHG

SEQ ID NO: 843091 - protein, 109 aa, Homo sapiens; identical to SEQ ID NO: 843082

SEQ ID NO: 843092 - protein, 109 aa, Homo sapiens; identical to SEQ ID NO: 843082

SEQ ID NO: 843093 - protein, 109 aa, Homo sapiens; identical to SEQ ID NO: 843082

SEQ ID NO: 843094 - protein, 96 aa, Homo sapiens
DGEREESPGDPGTASPRPLFAGLSDISISQDIPVEGEITIPMRSRIREFDSSTLNESVRNTIMRDLKAVGKKFMHVLYPRKSNTLLRDWDLLKWIK

SEQ ID NO: 843095 - protein, 109 aa, Homo sapiens; identical to SEQ ID NO: 843082

SEQ ID NO: 843096 - protein, 113 aa, Homo sapiens
AHCNLRLPDSSYSHASASQVAGITGAHYHTQLIFVFLVEVGFLHVGQTGLEFLTSSDPPASASRNAGITDVSPALPKIFILNIKTYLDIFRHGLFSLYYTFKYIKMKIKAEID

SEQ ID NO: 843097 - protein, 95 aa, Homo sapiens
MLQFPQLQNREILPMIILPRSDVVIKMVVKAFCKTLSKPGLACSGLAPTLSQLDRNLDREMKPDPTLLVTSRHNVFQNDEFNVFSRDSVNLSNQG

SEQ ID NO: 843098 - protein, 314 aa, Homo sapiens
AYLSRSTHRQNFKKEGSTLCSTANPETPNSTISREASTQSSSAATSQGYILPEGKIMPNTVFVGGIDVRMDETEIRSFFARYGSVKEVKIITDRTGVSKGYGFVSFFNDVDVQKIVESQINFHGKKLKLGPAIRKQNLCAYHVQPRPLVFNHPPPPQFQNVWTNPNTETYMQPTTTMNPITQYVQAYPTYPNSPVQVITGYQLPVYNYQMPPQWPVGEQRSYVVPPAYSAVNYHCNEVDPGAEVVPNECSVHEATPPSGNGPQKKSVDRSIQTVVSCLFNPENRLRNSVVTQDDYFKDKRVHHFRRSRAMLKSV

SEQ ID NO: 843099 - protein, 295 aa, Homo sapiens
MSTANPETPNSTISREASTQSSSAATSQGYILPEGKIMPNTVFVGGIDVRMDETEIRSFFARYGSVKEVKIITDRTGVSKGYGFVSFFNDVDVQKIVESQINFHGKKLKLGPAIRKQNLCAYHVQPRPLVFNHPPPPQFQNVWTNPNTETYMQPTTTMNPITQYVQAYPTYPNSPVQVITGYQLPVYNYQMPPQWPVGEQRSYVVPPAYSAVNYHCNEVDPGAEVVPNECSVHEATPPSGNGPQKKSVDRSIQTVVSCLFNPENRLRNSVVTQDDYFKDKRVHHFRRSRAMLKSV

SEQ ID NO: 843100 - protein, 264 aa, Homo sapiens
MESRKDITNQEEIWKMKPRRNLEDNDYLHEDTGETSMLKRPVLLHLQQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQVHGRINFLTL

SEQ ID NO: 843101 - protein, 285 aa, Homo sapiens
RSGGSGAAWGRHLPAAAAAETHGQATARSGWLKPYYFIELMESRKDITNQEEIWKMKPRRNLEDNDYLQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQVHGRINFLTL

SEQ ID NO: 843102 - protein, 259 aa, Homo sapiens
MESRKDITNQEEIWKMKPRRNLEDNDYLHEDTGETSMLKRPVLLHLQQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQRLLQE

SEQ ID NO: 843103 - protein, 304 aa, Homo sapiens
RSGGSGAAWGRHLPAAAAAETHGQATARSGWLKPYYFIELMESRKDITNQEEIWKMKPRRNLEDNDYLHEDTGETSMLKRPVLLHLQQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQVHGRINFLTL

SEQ ID NO: 843104 - protein, 135 aa, Homo sapiens
QWGQRLPREPVWAAPHGIPGTVGSEAPSGTCVGCPAWHPRNSGVRGSLGNPRGLPRMASQEQWGQRLPQEPAQAAQHGVPSSVQLEVPVVSAPWGVVVVLTILDGEVGEECRANTGGEAGGQAGRHTHRTFKTHR

SEQ ID NO: 843105 - protein, 180 aa, Homo sapiens
MVPSPHSGEVKGSKPTLLCLLCSRFKTLMTNKSEQDGDSSKTIEISDMKYHIFQMMMQYLYYGGTESMEIPTTDILELLSAASLFQLDALQRHCEILCSQTLSMESAVNTYKYAKIHNAPELALFCEGFFLKHMKALLEQDAFRQLIYGRSSKVQGLDPLQDLQNTLAERVHSVYITSRV

SEQ ID NO: 843106 - protein, 179 aa, Homo sapiens
YYSMDQRGQKPGDLYSPDSSPQANTQMSSSPVTSPTQSPAPSPVTSLSSVCTGLSPLPVLTQFPRPGYIPTTDILELLSAASLFQLDALQRHCEILCSQTLSMESAVNTYKYAKIHNAPELALFCEGFFLKHMKALLEQDAFRQLIYGRSSKVQGLDPLQDLQNTLAERVHSVYITSRV

SEQ ID NO: 843107 - protein, 108 aa, Homo sapiens
MGITESLLEMQSPRPHPSPPASSQAPQVAMCSVQFRKCWWRLRHFSQASNPGHIGQTRGREAHILTVDQSQVFRALSFAEHTRLHTRNSSQGRQGPEEDLAGISAEPH

SEQ ID NO: 843108 - protein, 279 aa, Homo sapiens
IWIESLRTSFSQSRYSVVQSLLRDFSSIREEEYNEELVTEGLQLMFDILKTSKNDSVIQQLATIFTHCYGSSPIPSIPEIRKTLPARLDPHFLNNKEMSDVTFLVEGKLFYAHKVLLVTASNRFKTLMTNKSEQDGDSSKTIEISDMKYHIFQMMMQYLYYGGTESMEIPTTDILELLSAASLFQLDALQRHCEILCSQTLSMESAVNTYKYAKIHNAPELALFCEGFFLKHMKALLEQDAFRQLIYGRSSKVQGLDPLQDLQNTLAERVHSVYITSRV

SEQ ID NO: 843109 - protein, 123 aa, Homo sapiens
IWIESLRTSFSQSRYSVVQSLLRDFSSIREEEYNEELVTEGLQLMFDILKTSKNDSVIQQLATIFTHCYGSSPIPSIPEIRKTLPARLDPHFLNNKEMSDVTFLVEGKLFYAHKVLLVTASNR

SEQ ID NO: 843110 - protein, 429 aa, Homo sapiens
VFTWHSGEWCALAVFCRSRPPLPSARPTNPDGTEGPQAKGDGPLSPDTASPLLQVPLAGSAAVVPERGDMPELVVTALLAPSRLSLKLLRAFMWSLVFSVALVAAAVYGCIALTHVLCRPRRGCCGRRRSASPACLSDPSLGEHGFLNLKSSGLRLHYVSAGRGNGPLMLFLHGFPENWFSWRYQLREFQSRFHVVAVDLRGYGPSDAPRDVDCYTIDLLLVDIKDVILGLGYSKCILVAHDWGALLAWHFSIYYPSLVERMVVVSGAPMSVYQDYSLHHISQFFRSHYMFLFQLPWLPEKLLSMSDFQILKTTLTHRKTGIPCLTPSELEAFLYNFSQPGGLTGPLNYYRNLFRNFPLEPQELTTPTLLLWGEKDTYLELGLVEAIGSRFVPGRLEAHILPGIGHWIPQSNPQEMHQYMWAFLQDLLD

SEQ ID NO: 843111 - protein, 355 aa, Homo sapiens
VFTWHSGEWCALAVFCRSRPPLPSARPTNPDGTEGPQAKGDGPLSPDTASPLLQVPLAGSAAVVPERGDMPELVVTALLAPSRLSLKLLRAFMWSLVFSVALVAAAVYGCIALTHVLCRPRRGCCGRRRSASPACLSDPSLGEHGFLNLKSSGLRLHYVSAGRGNGPLMLFLHGFPENWFSWRYQLREFQSRFHVVAVDLRGYGPSDAPRDVDCYTIDLLLVDIKDVILGLGYSKCILVAHDWGALLAWHFSIYYPSLVERMVVVSGAPMSVYQDYSLHHISQFFRSHYMFLFQLPWLPEKLLSMSDFQILKTTLTHRKTGIPCLTPSELEAFLYNFSQPGGLTGPLNYYRNLFR

SEQ ID NO: 843112 - protein, 279 aa, Homo sapiens
VFTWHSGEWCALAVFCRSRPPLPSARPTNPDGTEGPQAKGDGPLSPDTASPLLQVPLAGSAAVVPERGDMPELVVTALLAPSRLSLKLLRAFMWSLVFSVALVAAAVYGCIALTHVLCRPRRGCCGRRRSASPACLSDPSLGEHGFLNLKSSGLRLHYVSAGRGNGPLMLFLHGFPENWFSWRYQLREFQSRFHVVAVDLRGYGPSDAPRDVDCYTIDLLLVDIKDVILGLGYSKCILVAHDWGALLAWHFSIYYPSLVERMVVVSGAPMSVYQDYVFT

SEQ ID NO: 843113 - protein, 406 aa, Homo sapiens
MDQSGMEIPVTLIIKAPNQKYSDQTISCFLNWTVGKLKTHLSNVYPSKPLTKDQRLVYSGRLLPDHLQLKDILRKQDEYHMVHLVCTSRTPPSSPKSSTNRESHEALASSSNSSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYQAAVSAQATSNVNPTQPTTSQPLNLAHVPGEEPPPAPNLVAQENRPMNENVQMNAQGGPVLNEEDFNRDWLDWMYTFSRAAILLSIVYFYSSFSRFIMVMGAMLLVYLHQAGWFPFRQEGGHQQAPNNNAEVNNDGQNANNLELEEMERLMDDGLEDESGEDGGEDASAIQRPGLMASAWSFITTFFTSLIPEGPPQVAN

SEQ ID NO: 843114 - protein, 406 aa, Homo sapiens; identical to SEQ ID NO: 843113

SEQ ID NO: 843115 - protein, 422 aa, Homo sapiens
MDQSGMEIPVTLIIKAPNQKYSDQTISCFLNWTVGKLKTHLSNVYPSKPLTKDQRLVYSGRLLPDHLQLKDILRKQDEYHMVHLVCTSRTPPSSPKSSTNRESHEALASSSNSSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYIKPFLGPPQRVFQALPKRGARGPQQSNVNPTQPTTSQPLNLAHVPGEEPPPAPNLVAQENRPMNENVQMNAQGGPVLNEEDFNRDWLDWMYTFSRAAILLSIVYFYSSFSRFIMVMGAMLLVYLHQAGWFPFRQEGGHQQAPNNNAEVNNDGQNANNLELEEMERLMDDGLEDESGEDGGEDASAIQRPGLMASAWSFITTFFTSLIPEGPPQVAN

SEQ ID NO: 843116 - protein, 217 aa, Homo sapiens
MVKFFFLFNIYFGDYFSQAAVSAQATSNVNPTQPTTSQPLNLAHVPGEEPPPAPNLVAQENRPMNENVQMNAQGGPVLNEEDFNRDWLDWMYTFSRAAILLSIVYFYSSFSRFIMVMGAMLLVYLHQAGWFPFRQEGGHQQAPNNNAEVNNDGQNANNLELEEMERLMDDGLEDESGEDGGEDASAIQRPGLMASAWSFITTFFTSLIPEGPPQVAN

SEQ ID NO: 843117 - protein, 336 aa, Homo sapiens
MDQSGMEIPVTLIIKAPNQKYSDQTISCFLNWTVGKLKTHLSNVYPSKPLTKDQRLVYSGRLLPDHLQLKDILRKQDEYHMVHLVCTSRTPPSSPKSSTNRESHEALASSSNSSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYQAAVSAQATSNVNPTQPTTSQPLNLAHVPGEEPPPAPNLVAQENRPMNENVQMNAQGGPVLNEEDFNRDWLDWMYTFSRAAILLSIVYFYSSFSRFIMVMGAMLLVYLQTAVSSGAPNGKDRGHQRGAQM

SEQ ID NO: 843118 - protein, 406 aa, Homo sapiens; identical to SEQ ID NO: 843113

SEQ ID NO: 843119 - protein, 406 aa, Homo sapiens; identical to SEQ ID NO: 843113

SEQ ID NO: 843120 - protein, 342 aa, Homo sapiens
MDQSGMEIPVTLIIKAPNQKYSDQTISCFLNWTVGKLKTHLSNVYPSKPSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYQAAVSAQATSNVNPTQPTTSQPLNLAHVPGEEPPPAPNLVAQENRPMNENVQMNAQGGPVLNEEDFNRDWLDWMYTFSRAAILLSIVYFYSSFSRFIMVMGAMLLVYLHQAGWFPFRQEGGHQQAPNNNAEVNNDGQNANNLELEEMERLMDDGLEDESGEDGGEDASAIQRPGLMASAWSFITTFFTSLIPEGPPQVAN

SEQ ID NO: 843121 - protein, 406 aa, Homo sapiens; identical to SEQ ID NO: 843113

SEQ ID NO: 843122 - protein, 232 aa, Homo sapiens [sequence omitted]

SEQ ID NO: 843123 - protein, 188 aa, Homo sapiens
GGGQRLQVRVGSRWQDLLVTSWDTVDSIPKTVTRPCGDPRLIRKGILVIRKGWLTINNIGIMKGGSKEYWFVLTAENLSWYKDDEEKEKKYMLSVDNLKLRDVEKGFMSSKHIFALFNTEQRVVAVLVLFLPDPRLTLVGPLLLGDESSVQRPSEGSLESHGESWWDLGPKLETSLTMVVLLSKVQSP

SEQ ID NO: 843124 - protein, 889 aa, Homo sapiens
RGPRGAGSLGARLQRRSRKSEPGALAAAGSQPAGPAAAMGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 843125 - protein, 889 aa, Homo sapiens
RGPRGAGSLGARLQRRSRKSEPGALAAAGSQPAGPAAAMGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDLAFEATVKKQVQKLKEPSIKCVDMVVSELTATIRKCSEKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 843126 - protein, 277 aa, Homo sapiens
WAPPYQLRKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 843127 - protein, 841 aa, Homo sapiens
RGPRGAGSLGARLQRRSRKSEPGALAAAGSQPAGPAAAMGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVAHVQAHAAEPSTAARAHAEHRTPEYAGNLENPGTQSNE

SEQ ID NO: 843128 - protein, 802 aa, Homo sapiens
RGPRGAGSLGARLQRRSRKSEPGALAAAGSQPAGPAAAMGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDMVFPAVSPSTPKPVSWSWLF

SEQ ID NO: 843129 - protein, 329 aa, Homo sapiens
RGPRGAGSLGARLQRRSRKSEPGALAAAGSQPAGPAAAMGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQVGDQARMG

SEQ ID NO: 843130 - protein, 902 aa, Homo sapiens
RGPRGAGSLGARLQRRSRKSEPGALAAAGSQPAGPAAAMGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPSRSGQASPSRPESPRPPFDL

SEQ ID NO: 843131 - protein, 133 aa, Homo sapiens
MVQQFAVDFEKRIEGSGDQIDTYELSGGARINRIFHERFPFELVKMEFDEKELRREISYAIKNIHGIRTGLFTPDLAFEATVKKQVQKLKEPSIKCVDMVVSELTATIRKCSEKLHSTPATGGDERLGSSYNA

SEQ ID NO: 843132 - protein, 727 aa, Homo sapiens
CVLLLRDPRLSGCSGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 843133 - protein, 531 aa, Homo sapiens
MLGSTWEVPTPGGKGGPVPRSHCLLFSLSLYLCRCLSLFPRARAILSTPGFLSLLGFHPLLLPTHGCSSSCPHLLPGCRTGLFTPDLAFEATVKKQVQKLKEPSIKCVDMVVSELTATIRKCSEKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 843134 - protein, 902 aa, Homo sapiens; identical to SEQ ID NO: 843130

SEQ ID NO: 843135 - protein, 484 aa, Homo sapiens
RGPRGAGSLGARLQRRSRKSEPGALAAAGSQPAGPAAAMGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDLAFEATVKKQVQKLKEPSIKCVDMVVSELTATIRKCSEKV

SEQ ID NO: 843136 - protein, 123 aa, Homo sapiens
DGVLEDPYSERHQDLGTLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEKN

SEQ ID NO: 843137 - protein, 251 aa, Homo sapiens; identical to SEQ ID NO: 820284

SEQ ID NO: 843138 - protein, 251 aa, Homo sapiens; identical to SEQ ID NO: 820284

SEQ ID NO: 843139 - protein, 251 aa, Homo sapiens; identical to SEQ ID NO: 820284

SEQ ID NO: 843140 - protein, 251 aa, Homo sapiens; identical to SEQ ID NO: 820284

SEQ ID NO: 843141 - protein, 251 aa, Homo sapiens; identical to SEQ ID NO: 820284

SEQ ID NO: 843142 - protein, 251 aa, Homo sapiens; identical to SEQ ID NO: 820284

SEQ ID NO: 843143 - protein, 217 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEERNR

SEQ ID NO: 843144 - protein, 217 aa, Homo sapiens; identical to SEQ ID NO: 843143

SEQ ID NO: 843145 - protein, 214 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEKN

SEQ ID NO: 843146 - protein, 251 aa, Homo sapiens; identical to SEQ ID NO: 820284

SEQ ID NO: 843147 - protein, 217 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEAKAKTMMKNAQKKMNRLGKKRGGG

SEQ ID NO: 843148 - protein, 251 aa, Homo sapiens; identical to SEQ ID NO: 820284

SEQ ID NO: 843149 - protein, 330 aa, Homo sapiens
VQLNNVKSLIKIEVEENSILPFQDRELPHRIWLSICAHFNLQVFESIHSSFNYPRQAFNVSCWCFYQTIKSILDNVIAADPLKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843150 - protein, 174 aa, Homo sapiens [sequence omitted]

SEQ ID NO: 843151 - protein, 166 aa, Homo sapiens
RPPTTTKFAAASTKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843152 - protein, 196 aa, Homo sapiens
IELGPPEVAQLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843153 - protein, 192 aa, Homo sapiens
GRVGRPTRPLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843154 - protein, 176 aa, Homo sapiens
EIEYESLEFYLFKRWICYLYSFGLGVVVFDPFLQKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843155 - protein, 156 aa, Homo sapiens
DRSERIPSAPCESLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843156 - protein, 103 aa, Homo sapiens
MLAEKLPNLTHLNLSGNKLKDISTLEPLKKLECLKSLDLFNCEVTNLNDYRESVLTRKHLTQMPRWMVWMKRRRTKKEKMRKTRTMRMVKKRSLMKKMMKMKM

SEQ ID NO: 843157 - protein, 133 aa, Homo sapiens
TRRPRWMVWMKRNSKFTNSAVKPSIFPSFDLQLSKTSSRSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843158 - protein, 67 aa, Homo sapiens
TSAGLFGTRDDEDEDVEGDEDDDEVSEEEEEFGLDEEDEDEDEDEEEEEGGKGEKRKRETDDEGEDD

SEQ ID NO: 843159 - protein, 145 aa, Homo sapiens
QRWSSALTADPSKSDGPAQTYQDQWEDRIQVWHAEHRGMLKDNAMLEYLKIAQDLEMYGINYFEIKNKKGTDLWLGVDALGLNIYEKDDEDEDVEGDEDDDEVSEEEEEFGLDEEDEDEDEDEEEEEGGKGEKRKRETDDEGEDD

SEQ ID NO: 843160 - protein, 155 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFLGNLPPSLWTSPQQNCKRC

SEQ ID NO: 843161 - protein, 144 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLPKNSSCDIPPSFHVVPLGNLPPSLWTSPQQNCKRC

SEQ ID NO: 843162 - protein, 251 aa, Homo sapiens; identical to SEQ ID NO: 820284

SEQ ID NO: 843163 - protein, 165 aa, Homo sapiens
GRVGRPTRPLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEEKEEEEEERKKEKEDRRKEDRRRKEEKKNKEQEERRKKKRKKRKKKEKK

SEQ ID NO: 843164 - protein, 251 aa, Homo sapiens; identical to SEQ ID NO: 820284

SEQ ID NO: 843165 - protein, 251 aa, Homo sapiens; identical to SEQ ID NO: 820284

SEQ ID NO: 843166 - protein, 251 aa, Homo sapiens; identical to SEQ ID NO: 820284

SEQ ID NO: 843167 - protein, 196 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEEDD

SEQ ID NO: 843168 - protein, 250 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEERRRIWAVMKTMKIRIRIKRTKNVGIVKRGRVPLMNEDF

SEQ ID NO: 843169 - protein, 199 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEGRRIWT

SEQ ID NO: 843170 - protein, 251 aa, Homo sapiens; identical to SEQ ID NO: 820284

SEQ ID NO: 843171 - protein, 276 aa, Homo sapiens
EAEEEQEENLEASGDYEIFRKEEGNMDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843172 - protein, 215 aa, Homo sapiens
TRGSRLVQPFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843173 - protein, 160 aa, Homo sapiens
MVFYRIPTLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843174 - protein, 184 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVLTRKHLTQMPRWMVWMKRRRTKKEKMRKTRTMRMVKKRSLMKKMMKMKM

SEQ ID NO: 843175 - protein, 204 aa, Homo sapiens
RPPTTTKFAAASTKLKDISTLEPLSLFPLKFRCVRFGSFSANMSSLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843176 - protein, 170 aa, Homo sapiens
MTIPCTRRDTNLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843177 - protein, 160 aa, Homo sapiens
DGVLEDPYSERHQDLGTLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843178 - protein, 145 aa, Homo sapiens
SKDPLHSQIITIHLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 843179 - protein, 77 aa, Homo sapiens
QLQNYSSLLNDYISGKLNWSFCVVYAQMERLPWLDGFLVSLLESERSLLDKEKMRKTRTMRMVKKRSLMKKMMKMKM

SEQ ID NO: 843180 - protein, 144 aa, Homo sapiens; identical to SEQ ID NO: 843161

SEQ ID NO: 843181 - protein, 84 aa, Homo sapiens
VMVFYRIPTLKDISTLEPLKKLECLKSLDLFNCEVTNLNDYRESVFKLLPQLTYLDGYDREDQEAPDSDAEVDGVDEEEEDEGE

SEQ ID NO: 843182 - protein, 506 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 843183 - protein, 461 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGSEGFLKGPLSEETEASDSVDGGHDSVILDPERLEPGLDEEDTDFEEEDDNPDWVSELKKRAGWQGLCDR

SEQ ID NO: 843184 - protein, 506 aa, Homo sapiens; identical to SEQ ID NO: 843182

SEQ ID NO: 843185 - protein, 444 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKQEEEQDRKGSHTDLESINENLVESALRRVNREEKGNKSVHLRKASSPNLHRRQWEKNVPNTALTALENASILTSSLTAEDDRGSEGFLKGPLSEETEASDSVDGGHDSVILDPERLEPGLDEEDTDFEEEDDNPDWVSELKKRAGWQGLCDR

SEQ ID NO: 843186 - protein, 273 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMNM

SEQ ID NO: 843187 - protein, 506 aa, Homo sapiens; identical to SEQ ID NO: 843182

SEQ ID NO: 843188 - protein, 493 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPEPRLGVRAEEASWMARPVRQIMPEEMFLSHAEESLHSGVHAEMIMSSCDVYFPLETE

SEQ ID NO: 843189 - protein, 497 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTYVVICIESCSWGWGCVCV

SEQ ID NO: 843190 - protein, 140 aa, Homo sapiens
MNDCIIRGDLANVRVGRHCVVKSRSVIRPPFKKFSKGVAFFPLHIGDHVFIEEDCVVNAAQIGSYVHVGKNCVIGRRCVLKDCCKILDNTVLPPETVVPPFTVFSGCPGLFSGELPECTQELMIDVTKSYYQKFLPLTQV

SEQ ID NO: 843191 - protein, 182 aa, Homo sapiens
MELGELLYNKSEYIETASGNKVSRQSVLCGSQNIVLNGKTIVMNDCIIRGDLANVRVGRHCVVKSRSVIRPPFKKFSKGVAFFPLHIGDHVFIEEDCVVNAAQIGSYVHVGKNCVIGRRCVLKDCCKILDNTVLPPETVVPPFTVFSGCPGLFSGELPECTQELMIDVTKSYYQKFLPLTQV

SEQ ID NO: 843192 - protein, 182 aa, Homo sapiens; identical to SEQ ID NO: 843191

SEQ ID NO: 843193 - protein, 182 aa, Homo sapiens; identical to SEQ ID NO: 843191

SEQ ID NO: 843194 - protein, 182 aa, Homo sapiens; identical to SEQ ID NO: 843191

SEQ ID NO: 843195 - protein, 182 aa, Homo sapiens; identical to SEQ ID NO: 843191

SEQ ID NO: 843196 - protein, 144 aa, Homo sapiens
MAMARLGSWLGEAQWLALVSLFVAALATVGLYLAQWALARARPQPQRRAVEPGEGPRPGSDALLSWILTLGSWRSQWQAAWVTALNEEAERKGVLQALGSARDRLAVGGTVRSAHPRQPVPALPGVPGRIPVPDRTLTELAHDT

SEQ ID NO: 843197 - protein, 128 aa, Homo sapiens
MLLENIILLLLATDFLQGASWTSLQTIAGVLSGFLIAQQASTTVTLRPAVGPSKPAPAPLTWGLVLLQHGPGQRFPSPLQQLLPSLQSLLSVTHTLKRCLEVASGSFLAHSSRGLDVACVSGLDLGKE

SEQ ID NO: 843198 - protein, 117 aa, Homo sapiens [sequence omitted]

SEQ ID NO: 843199 - protein, 483 aa, Homo sapiens
MKEEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEIEAKNRELIAKKTTPLLSFLKNKQRMREEKREERRRREIERKRQREEERRKWKEEEKRKRKDIEKLKKIDRIPERDKLKDEPKIKVHRFLLQAVNQKNLLKKPEKGDEKELDKREKAKKLDKENLSDERASGQSCTLPKRSDSELKDEKPKRPEDESGRDYREREREYERDQERILRERERLKRQEEERRRQKERYEKEKTFKRKEEEMKKEKDTLRDKGKKAESTESIGSSEKTEKKEEVVKRDRIRNKDRPAMQLYQPGARSRNRLCPPDDSTKSGDSAAERKQESGISHRKEGGEE

SEQ ID NO: 843200 - protein, 483 aa, Homo sapiens; identical to SEQ ID NO: 843199

SEQ ID NO: 843201 - protein, 479 aa, Homo sapiens
KNVTARYEAGVVEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEIEAKNRELIAKKTTPLLSFLKNKQRMREEKREERRRREIERKRQREEERRKWKEEEKRKRKDIEKLKKIDRIPERDKLKDEPKIKLLKKPEKGDEKELDKREKAKKLDKENLSDERASGQSCTLPKRSDSELKDEKPKRPEDESGRDYREREREYERDQERILRERERLKRQEEERRRQKERYEKEKTFKRKEEEMKKEKDTLRDKGKKAESTESIGSSEKTEKKEEVVKRDRIRNKDRPAMQLYQPGARSRNRLCPPDDSTKSGDSAAERKQESGISHRKEGGEE

SEQ ID NO: 843202 - protein, 483 aa, Homo sapiens; identical to SEQ ID NO: 843199

SEQ ID NO: 843203 - protein, 256 aa, Homo sapiens
MKEEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEIEAKNRELIAKKTTPLLSFLKNKQRMREEKRDDRGGERHSNETRPEKREGDWDERERKEDLKAEDDESEGLW

SEQ ID NO: 843204 - protein, 136 aa, Homo sapiens
KNVTARYEAGVVEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGESW

SEQ ID NO: 843205 - protein, 470 aa, Homo sapiens
MKEEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEIEAKNRELIAKKTTPLLSFLKNKQRMREEKREERRRREIERKRQREEERRKWKEEEKRKRKDIEKLKKIDRIPERDKLKDEPKIKLLKKPEKGDEKELDKREKAKKLDKENLSDERASGQSCTLPKRSDSELKDEKPKRPEDESGRDYREREREYERDQERILRERERLKRQEEERRRQKERYEKEKTFKRKEEEMKKEKDTLRDKGKKAESTESIGSSEKTEKKEEVVKRDRIRNKDRPAMQLYQPGARSRNRLCPPDDSTKSGDSAAERKQESGISHRKEGGEE

SEQ ID NO: 843206 - protein, 483 aa, Homo sapiens; identical to SEQ ID NO: 843199

SEQ ID NO: 843207 - protein, 500 aa, Homo sapiens
MKEEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEIEAKNRELIAKKTTPLLSFLKNKQRMREEKREERRRREIERKRQREEERRKWKEEEKRKRKDIEKLKKIDRIPERDKLKDEPKIKVHRFLLQAVNQKNVRTKYMNRASSIMSHTQLLKKPEKGDEKELDKREKAKKLDKENLSDERASGQSCTLPKRSDSELKDEKPKRPEDESGRDYREREREYERDQERILRERERLKRQEEERRRQKERYEKEKTFKRKEEEMKKEKDTLRDKGKKAESTESIGSSEKTEKKEEVVKRDRIRNKDRPAMQLYQPGARSRNRLCPPDDSTKSGDSAAERKQESGISHRKEGGEE

SEQ ID NO: 843208 - protein, 455 aa, Homo sapiens
MKEEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEILSFLKNKQRMREEKREERRRREIERKRQREEERRKWKEEEKRKRKDIEKLKKIDRIPERDKLKDEPKIKLLKKPEKGDEKELDKREKAKKLDKENLSDERASGQSCTLPKRSDSELKDEKPKRPEDESGRDYREREREYERDQERILRERERLKRQEEERRRQKERYEKEKTFKRKEEEMKKEKDTLRDKGKKAESTESIGSSEKTEKKEEVVKRDRIRNKDRPAMQLYQPGARSRNRLCPPDDSTKSGDSAAERKQESGISHRKEGGEE

SEQ ID NO: 843209 - protein, 128 aa, Homo sapiens
LINLESFCLMQTGPFPSLSFFSKVPKGAERPLFPICSTELQCFLVIQSTSPQSCKTEKPNLQILYFLYDPQKHGETKGTISHRIKRMERGRNMNYRIEENGQKIENKRRRGNLLLPLSGKESDRNISY

SEQ ID NO: 843210 - protein, 108 aa, Homo sapiens
MHCPGSCRTPRVGRGRWLSRSSQVPATAVRDCPPLGIMCVGPGSTGVGAGDPRPRILRALPPFPGPRWPVGMRRAGRQSFGPKAGVGGSPLKFGAVSVVVAEDRRLGS

SEQ ID NO: 843211 - protein, 663 aa, Homo sapiens
MEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGEAGARLCLGSVGRGLCLVLPLLCLGAGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGVSTLDSPTTPGAPGAGQGNLGGTAASECQDFTFPHQDTREQPPGYAIDTVQVNGQEKYLIVSAGAARPVPEGGPGDTQACLADLAQHGPRGTEPQGPFLRPLLSQLCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPWVPSSAALGTSSVCHPSSGQRWCQAWNWGLAVSVIRAVGSSGVRPGTGARVAGWSFVWQMILLSCRHLVHAELHPSSFWLRGLLGVVGAAVAAVLSFSLYRVLVKSQ

SEQ ID NO: 843212 - protein, 653 aa, Homo sapiens
SGGTGSAGRARGQSERLEDQVGAGFRVGERLRAAAMRRDVRILLLGEAQVGKTSLILSLVGEEFPEEVPPRAEEITIPADVTPEKVPTHIVDYSEAEQTDEELREEIHKANVVCVVYDVSEEATIEKIRTKWIPLVNGGTTQGPRVPIILVGNKSDLRSGSSMEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 843213 - protein, 491 aa, Homo sapiens
MEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 843214 - protein, 491 aa, Homo sapiens; identical to SEQ ID NO: 843213

SEQ ID NO: 843215 - protein, 525 aa, Homo sapiens
MEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGVSTLDSPTTPGAPGAGQGNLGGTAASECQDFTFPHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 843216 - protein, 359 aa, Homo sapiens
MRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 843217 - protein, 518 aa, Homo sapiens
MEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGEAGCPPVPGECGEGAVPGAPLLCLGAGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 843218 - protein, 491 aa, Homo sapiens; identical to SEQ ID NO: 843213

SEQ ID NO: 843219 - protein, 525 aa, Homo sapiens
MEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKVGPCRGHVAMGQGLSLQLCLGHPRTVPHTTLCPQHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 843220 - protein, 548 aa, Homo sapiens
MEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYSGGRHETTWTILRRFGYSDALELTADYLSPLIHVPPGCSTELNHLGYQFEGLYPPFLVLGGQWV

SEQ ID NO: 843221 - protein, 260 aa, Homo sapiens
MEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILTFGPRRAASLFLLAPGAAGGCRGRRGRSPQLLTLQGPGEEPVRPLVPKPPPLTWVCLAAGALQGQHSWGAGQAATPGTPLRRDFLFLKAVDLQRGLMLPCTALAPAGPPGWAVAGG

SEQ ID NO: 843222 - protein, 138 aa, Homo sapiens
MEAVLPIMSQFPEIETCVECSAKNLRNISELFYYAQKAVLHPTAPLYDPEAKQKSCFGHPLAPQALEDVKTVVCRNVAGGVREDRLTLDGFLFLNTLFIQRGRHETTWTILRRFGYSDALELTADYLSPLGSTPLSWS

SEQ ID NO: 843223 - protein, 209 aa, Homo sapiens
SGGTGSAGRARGQSERLEDQVGAGFRVGERLRAAAMRRDVRILLLGEAQVGKTSLILSLVGEEFPEEVPPRAEEITIPADVMGERVANPTIRGNKLQERPKPRREEGKPVRKGKIHKEFEKIRCEFPTGCALVGGSTNSDGGPRVCAPSHSIVGGTQGLETRARCGENVSCGSAVWFPRFLRSPRFSPEEIVERPWGVVRIGVRGQRNA

SEQ ID NO: 843224 - protein, 344 aa, Homo sapiens
SGGTGSAGRARGQSERLEDQVGAGFRVGERLRAAAMRRDVRILLLGEAQVGKTSLILSLVGEEFPEEVPPRAEEITIPADVTPEKVPTHIVDYSEAEQTDEELREEIHKANVVCVVYDVSEEATIEKIRTKWIPLVNGGTTQGPRVPIILVGNKSDLRSGSSMEAVLPIMSQFPEIETCVECSAKNLRNISELFYYAQKAVLHPTAPLYDPEAKQKSCFGHPLAPQALEDVKTVVCRNVAGGVREDRLTLDGFLFLNTLFIQRGRHETTWTILRRFGYSDAWDGWDMFPSDQCPGEEGQHWSPVAKVVSRTAEGPCGEKLRPQLANRNQEAADSLTGGDRDRRQ

SEQ ID NO: 843225 - protein, 457 aa, Homo sapiens
MEAVLPIMSQFPEIETCVELRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 843226 - protein, 496 aa, Homo sapiens
MEAVLPIMSQFPEIETCVELRPACAQALTRIFRLSDQDLDQALSDEELNAFQVCPCPTLGAQPPGTSAAVSDWNGSSPGGWLTPNNFSRKQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 843227 - protein, 317 aa, Homo sapiens
LGRLLELLQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 843228 - protein, 570 aa, Homo sapiens
MEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGVSTLDSPTTPGAPGAGQGNLGGTAASECQDFTFPHQDTREQPPGYAIDTVQVNGQEKYLIVSAGAARPVPEGGPGDTQACLADLAQHGPRGTEPQGPFLRPLLSQLCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 843229 - protein, 619 aa, Homo sapiens
MEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPWVPSSAALGTSSVCHPSSGQRWCQAWNWGLAVSVIRAVGSSGVRPGTGARVAGWSFVWQREAVPRLSLQGLASTGCASGLGSPPVGPCESRTWEGAQQQAGGMCLRYLQMILLSCRHLVHAELHPSSFWGTPLRRDFLFLKAVDLQRGLMLPCTALAPAGPPGWAVAGG

SEQ ID NO: 843230 - protein, 249 aa, Homo sapiens
MEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTERLCAGTFCF

SEQ ID NO: 843231 - protein, 69 aa, Homo sapiens
LGAGFLFLNTLFIQRGRHETTWTILRRFGYSDALELTADYLSPLVSDAGAVRPALPEGQELTADYLSPP

SEQ ID NO: 843232 - protein, 88 aa, Homo sapiens
MGVQGLWKLLECSGRQVSPEALEGKILAVGILNAALGLGVQGFGAGFLAGLCLGHSGICRMMVLGRGRGRYRISVTRFSKYSRPSVSP

SEQ ID NO: 843233 - protein, 873 aa, Homo sapiens
MHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKRKTQKRGITNTLEESSSLKRKRLSDSKRKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 843234 - protein, 1032 aa, Homo sapiens
VDYYYKIRGRVDERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKRKTQKRGITNTLEESSSLKRKRLSDSKRKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 843235 - protein, 856 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLENGGMKLKKIQR

SEQ ID NO: 843236 - protein, 165 aa, Homo sapiens [sequence omitted]

SEQ ID NO: 843237 - protein, 1130 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKRKTQKRGITNTLEESSSLKRKRLSDSKRKNTCGGFLGETCLSESSDGSSSEDAESSSLMNVQRRTAAKEPGGATTSSS

SEQ ID NO: 843238 - protein, 746 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLQPVLFLL

SEQ ID NO: 843239 - protein, 398 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPHGPEEGHCKWELGLPKRPRAGAL

SEQ ID NO: 843240 - protein, 1186 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKRKTQKRGITNTLEESSSLKRKRLSDSKRKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 843241 - protein, 1168 aa, Homo sapiens
MHINTKFYLLRYISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKRKTQKRGITNTLEESSSLKRKRLSDSKRKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 843242 - protein, 419 aa, Homo sapiens
MFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKRKTQKRGITNTLEESSSLKRKRLSDSKRKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 843243 - protein, 1186 aa, Homo sapiens; identical to SEQ ID NO: 843240

SEQ ID NO: 843244 - protein, 882 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNSSNTRALPSYTYVALHNPMRTRLTSATHRLHSSRRCLPLYVSSHLLTLSSGLASFLLP

SEQ ID NO: 843245 - protein, 142 aa, Homo sapiens [sequence omitted]

SEQ ID NO: 843246 - protein, 255 aa, Homo sapiens
MDPTCSSECIYNLIPSDLKEPPQPPRYISIFKATVKDDMQKAKTAMKTMGPAKVEVPSPKDFLKKHSKEKTLPPKKNFDRNVPKKPAVPLKTDHPVMGIQSGKNFINTNAADIIMGVAKKPKPIYVDKRTGDKHDLEPSGLVPKYINKKDYGVTPEYICKRNEEIKKAQEDYDRYIQENLKKAAMKRLSDEEREAVLQGLKKNWEEVHKEFQSLSVFIDSIPKKIRKQRLEEEMKQLEHDIGIIEKHKIIYIANK

SEQ ID NO: 843247 - protein, 159 aa, Homo sapiens
MGIQSGKNFINTNAADIIMGVAKKPKPIYVDKRTGDKHDLEPSGLVPKYINKKDYGVTPEYICKRNEEIKKAQEDYDRYIQENLKKAAMKRLSDEEREAVLQGLKKNWEEVHKEFQSLSVFIDSIPKKIRKQRLEEEMKQLEHDIGIIEKHKIIYIANK

SEQ ID NO: 843248 - protein, 121 aa, Homo sapiens
PPVSKDATMKRHSGGYDWVVTVAHARRASPPQPLCHLRACSPATCPRARIQACKRPHAMRRHISGGQPGTRCGVSLAAVPPKRGGPCRTTARPPARAREVMGTARDMPNPTGGLGGEALSS

SEQ ID NO: 843249 - protein, 68 aa, Homo sapiens
NHRCGVLGKIKVESAFHTPTGDVRRHGGPDTKLRHSTVQFGEYTRPGLASWSGGTSSEQKSDKETCVH

SEQ ID NO: 843250 - protein, 615 aa, Homo sapiens
MNALALGPSEYDSLPENSETGGNESQPDSQEDPREVLKKTLEFCLSRENLASDMYLISQMDSDQYVPITTVANLDHIKKLSTDVDLIVEVLRSLPLVQVDEKGEKVRPNQNRCIVILREISESTPVEEVEALFKGDNLPKFINCEFAYNDNWFITFETEADAQQAYKYLREEVKTFQGKPIKARIKAKAIAINTFLPKNGFRPLDVSLYAQQRYATSFYFPPMYSPQQQFPLYSLITPQTWSATHSYLDPPLVTPFPNTGFINGFTSPAFKPAASPLTSLRQYPPRSRNPSKSHLRHAIPSAERGPGLLESPSIFNFTADRLINGVRSPQTRQAGQTRTRIQNPSAYAKREAGPGRVEPGSLESSPGLGRGRKNSFGYRKKREEKFTSSQTQSPTPPKPPSPSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 843251 - protein, 738 aa, Homo sapiens
MTSDQDAKVVAEPQTQRVQEGKDSAHLMNGPISQTTSQTSSIPPLSQVPATKVSELNPNAEVWGAPVLHLEASSAADGVSAAWEEVAGHHADRGPQGSDANGDGDQGHENAALPDPQESDPADMNALALGPSEYDSLPENSETGGNESQPDSQEDPREVLKKTLEFCLSRENLASDMYLISQMDSDQYVPITTVANLDHIKKLSTDVDLIVEVLRSLPLVQVDEKGEKVRPNQNRCIVILREISESTPVEEVEALFKGDNLPKFINCEFAYNDNWFITFETEADAQQAYKYLREEVKTFQGKPIKARIKAKAIAINTFLPKNGFRPLDVSLYAQQRYATSFYFPPMYSPQQQFPLYSLITPQTWSATHSYLDPPLVTPFPNTGFINGFTSPAFKPAASPLTSLRQYPPRSRNPSKSHLRHAIPSAERGPGLLESPSIFNFTADRLINGVRSPQTRQAGQTRTRIQNPSAYAKREAGPGRVEPGSLESSPGLGRGRKNSFGYRKKREEKFTSSQTQSPTPPKPPSPSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 843252 - protein, 773 aa, Homo sapiens
MTSDQDAKVVAEPQTQRVQEGKDSAHLMNGPISQTTSQTSSIPPLSQVPATKVSELNPNAEVWGAPVLHLEASSAADGVSAAWEEVAGHHADRGPQGSDANGDGDQGHENAALPDPQESDPADMNALALGPSEYDSLPENSETGGNESQPDSQEDPREVLKKTLEFCLSRENLASDMYLISQMDSDQYVPITTVANLDHIKKLSTDVDLIVEVLRSLPLVQVDEKGEKVRPNQNRCIVILREISESTPVEEVEALFKGDNLPKFINCEFAYNDNWFITFETEADAQQAYKYLREEVKTFQGKPIKARIKAKAIAINTFLPKNGFRPLDVSLYAQQRYATSFYFPPMYSPQQQFPLYSLITPQTWSATHSYLDPPLVTPFPNTGFINGFTSPAFKPAASPLTSLRQYPPRSRNPSKSHLRHAIPSAERGPGLLESPSIFNFTADRLINGVRSPQTRQAGQTRTRIQNPSAYAKREAGPGRVEPGSLESSPGLGRGRKNSFGYRKKREEKFTSSQTQSPTPPKPPSPSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATVRTSCLPSCTTAARLWCEQTLRTPAPARFLITSNLELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 843253 - protein, 738 aa, Homo sapiens; identical to SEQ ID NO: 843251

SEQ ID NO: 843254 - protein, 393 aa, Homo sapiens [sequence omitted]

SEQ ID NO: 843255 - protein, 128 aa, Homo sapiens
KDCFWSLPFRVEYRVRVHCPPWAPGTPFCCPELAEPVWAASGLFLGFRIAQAGIGLGRDGVESALFFVMPFLILSITTVAQRECSAAGETKSLDFMNFLKVKNTSEDGNLVTVENSFILSELDFLSCP

SEQ ID NO: 843256 - protein, 738 aa, Homo sapiens; identical to SEQ ID NO: 843251

SEQ ID NO: 843257 - protein, 738 aa, Homo sapiens; identical to SEQ ID NO: 843251

SEQ ID NO: 843258 - protein, 513 aa, Homo sapiens [sequence omitted]

SEQ ID NO: 843259 - protein, 160 aa, Homo sapiens
MTSDQDAKVVAEPQTQRVQEGKDSAHLMNGPISQTTSQTSSIPPLSQVPATKVSELNPNAEVWGAPVLHLEASSAADGVSAAWEEVAGHHADRGPQGSDANGDGDQGHENAALPDPQESDPADMNALALGPSEYDSLPENSETGGNESQPDSQELVDRYR

SEQ ID NO: 843260 - protein, 738 aa, Homo sapiens; identical to SEQ ID NO: 843251

SEQ ID NO: 843261 - protein, 738 aa, Homo sapiens; identical to SEQ ID NO: 843251

SEQ ID NO: 843262 - protein, 738 aa, Homo sapiens; identical to SEQ ID NO: 843251

SEQ ID NO: 843263 - protein, 738 aa, Homo sapiens; identical to SEQ ID NO: 843251

SEQ ID NO: 843264 - protein, 393 aa, Homo sapiens [sequence omitted]

SEQ ID NO: 843265 - protein, 176 aa, Homo sapiens
MFQTLSADASVNTLPVVVSREPSVPASCAVSATYERSPSPAHLPDDPKVAEKQRETHSVDRLPSALTATACKSVQVNGAATELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 843266 - protein, 738 aa, Homo sapiens; identical to SEQ ID NO: 843251

SEQ ID NO: 843267 - protein, 714 aa, Homo sapiens
MTSDQDAKVVAEPQTQRVQEGKDSAHLMNGPISQTTSQTSSIPPLSQVPATKVSELNPNAEVWGAPVLHLEASSAADGVSAAWEEVAGHHADRGPQGSDANGDGDQGHENAALPDPQESDPADMNALALGPSEYDSLPENSETGGNESQPDSQEDPREVLKKTLEFCLSRENLASDMYLISQMDSDQYVPITTVANLDHIKKLSTDVDLIVEVLRSLPLVQVDEKGEKVRPNQNRCIVILREISESTPVEEVEALFKGDNLPKFINCEFAYNDNWFITFETEADAQQAYKYLREEVKTFQGKPIKARIKAKAIAINTFLPKNGFRPLDVSLYAQQRYATSFYFPPMYSPQQQFPLYSLITPQTWSATHSYLDPPLVTPFPNTGFINGFTSPAFKPAASPLTSLRQYPPRSRNPSKSHLRHAIPSAERGPGLLESPSIFNFTADRLINGVRSPQTRQAGQTRTRIQNPSAYAKREAGPGRVEPGSLESSPGLGRGRKNSFGYRKKREEKFTSSQTQSPTPPKPPSPSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATVRTSCLPSCTTAARLWCEQTLRTPAPARFLITSNLVGFYLRLSVLCFLYKIPLIFANNFPLTTLVLSQTTM

SEQ ID NO: 843268 - protein, 170 aa, Homo sapiens [sequence omitted]

SEQ ID NO: 843269 - protein, 50 aa, Homo sapiens
MRGGHVLEARGRIHTLSLHMAQPQTLDKMRGREWPLLQTQCIWPSPQRAS

SEQ ID NO: 843270 - protein, 310 aa, Homo sapiens
MGDNITSIREFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLAIMTWRVCITLAVTSWTTGVLLSLIHLVLLLPLPFCRPQKIYHFFCEILAVLKLACADTHINENMVLAGAISGLVGPLSTIVVSYMCILCAILQIQSREVQRKAFRTCFSHLCVIGLVYGTAIIMYVGPRYGNPKEQKKYLLLFHSLFNPMLNPLICSLRNSEVKNTLKRVLGVERAL

SEQ ID NO: 843271 - protein, 245 aa, Homo sapiens
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRLNFFKSYFGPFELLGSILDCWNYRLHSEILFHGLKMPYFIGAFFHHAF

SEQ ID NO: 843272 - protein, 435 aa, Homo sapiens
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRERSSKIQCAWLLVFLAGSSVLLYYTFHSQSLYYSLIFLNPTLDHLSFWEVFWIVGITDFILKFFFMGLKCLILLVPSFIMPFKSKGYWYMLLEELCQYYRTFVPIPVWFRYLISYGEFGNVTRWSLGILLALLYLILKLLEFFGHLRTFRQVLRIFFTQPSYGVAASKRQCSDVDDICSICQAEFQKPILLICQHIFCEECMTLWFNREKTCPLCRTVISDHINKWKDGATSSHLQIY

SEQ ID NO: 843273 - protein, 435 aa, Homo sapiens; identical to SEQ ID NO: 843272

SEQ ID NO: 843274 - protein, 237 aa, Homo sapiens
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRERSSKIQCAWLLVFLAGSSVLLYYTFHSQSLYYRLERCQL

SEQ ID NO: 843275 - protein, 172 aa, Homo sapiens
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITA

SEQ ID NO: 843276 - protein, 398 aa, Homo sapiens
MQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRERSSKIQCAWLLVFLAGSSVLLYYTFHSQSLYYSLIFLNPTLDHLSFWEVFWIVGITDFILKFFFMGLKCLILLVPSFIMPFKSKGYWYMLLEELCQYYRTFVPIPVWFRYLISYGEFGNVTRWSLGILLALLYLILKLLEFFGHLRTFRQVLRIFFTQPSYGVAASKRQCSDVDDICSICQAEFQKPILLICQHIFCEECMTLWFNREKTCPLCRTVISDHINKWKDGATSSHLQIY

SEQ ID NO: 843277 - protein, 199 aa, Homo sapiens
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRVR

SEQ ID NO: 843278 - protein, 435 aa, Homo sapiens; identical to SEQ ID NO: 843272

SEQ ID NO: 843279 - protein, 237 aa, Homo sapiens; identical to SEQ ID NO: 843274

SEQ ID NO: 843280 - protein, 438 aa, Homo sapiens
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRERSSKIQCAWLLVFLAGSSVLLYYTFHSQSLYYSLIFLNPTLDHLSFWEVFWIVGITDFILKFFFMGLKCLILLVPSFIMPFKSKGYWYMLLEELCQYYRTFVPIPVWFRYLISYGEFGNVTRWSLGILLALLYLILKLLEFFGHLRTFRQVLRIFFTQPSYGVAASKRQCSDVDDICSICQAEFQKPILLICQHIFCEECMTLWFNREKTCPLCRTVISDHINKWKDGANFQSKKLFQKI

SEQ ID NO: 843281 - protein, 67 aa, Homo sapiens
LRLCKAGCTLGSHVLQEEPSGNDRIGLEDKYPGLLIPQWDDSAACLRWLPGNSTPDAHTNNLVSHSS

SEQ ID NO: 843282 - protein, 252 aa, Homo sapiens
LPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAAGANKPEGRPHTAVPTAVNVTSASHAVAPLQEIKQNLHTWNSSLLDLETLSLQSRAARLLKRSKASISSSSSLSPSDASTSSFPTSSDGLSPFSETFIPDSSKGLGPRAP

SEQ ID NO: 843283 - protein, 122 aa, Homo sapiens
CQFSPFKIVPLEMRPWVEATTGHPRARPGVPRYINRFRQAQPTSREERQPAGPTPADFWWLQSDSPDPSSQSAAAGANKPEGRPHTAVPTAVNVTSASHAVAPLQEIKQVTSPFTPSLGCLN

SEQ ID NO: 843284 - protein, 154 aa, Homo sapiens
LPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAGTSFSAIHYSHP

SEQ ID NO: 843285 - protein, 190 aa, Homo sapiens
LPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAAGANKPEGRPHTAVPTAVNVTSASHAVAPLQEIKQVTSPFTPSLGCLN

SEQ ID NO: 843286 - protein, 1055 aa, Homo sapiens
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPTATAAAVAAAAQPQPSVAETYYQTAPKAGYSQGATQYTQAQQTRQVTAIKPATPSPATTTFSIYPVSSTVQPVAAAATVVPSYTQSATYSTTAVTYSGTSYSGYEAAVYSAASSYYQQQQQQQKQAAAAAAAAAATAAWTGTTFTKKAPFQNKQLKPKQPPKPPQIHYCDVCKISCAGPQTYKEHLEGQKHKKKEAALKASQNTSSSNSSTRGTQNQLRCELCDVSCTGADAYAAHIRGAKHQKVVKLHTKLGKPIPSTEPNVVSQATSSTAVSASKPTASPSSIAANNCTVNTSSIATSSMKGLTTTGNSSLNSTSNTKVSAVPTNMAAKKTSTPKINFVGGNKLQSTGNKAEDIKGTECVKSTPVTSAVQIPEVKQDTVSEPVTPASLAALQSDVQPVGHDYVEEVRNDEGKVIRFHCKLCECSFNDPNAKEMHLKGRRHRLQYKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 843287 - protein, 1037 aa, Homo sapiens
SSVLWSSMDQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPTATAAAVAAAAQPQPSVAETYYQTAPKAGYSQGATQYTQAQQTRQVTAIKPATPSPATTTFSIYPVSSTVQPVAAAATVVPSYTQSATYSTTAVTYSGTSYSGYEAAVYSAASSYYQQQQQQQKQAAAAAAAAAATAAWTGTTFTKKAPFQNKQLKPKQPPKPPQIHYCDVCKISCAGPQTYKEHLEGQKHKKKEAALKASQNTSSSNSSTRGTQNQLRCELCDVSCTGADAYAAHIRGAKHQKVVKLHTKLGKPIPSTEPNVVSQATSSTAVSASKPTASPSSIAANNCTVNTSSIATSSMKGLTTTGNSSLNSTSNTKVSAVPTNMAAKKTSTPKINFVGGNKLQSTGNKAEDIKGTECVKSTPVTSAVQIPEVKQDTVSEPVTPASLAALQSDVQPVGHDYVEEVRNDEGKVIRFHCKLCECSFNDPNAKEMHLKGRRHRLQYKKKVNPDLQVEVKPSIRARKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 843288 - protein, 954 aa, Homo sapiens
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQQQQQKQAAAAAAAAAATAAWTGTTFTKKAPFQNKQLKPKQPPKPPQIHYCDVCKISCAGPQTYKEHLEGQKHKKKEAALKASQNTSSSNSSTRGTQNQLRCELCDVSCTGADAYAAHIRGAKHQKVVKLHTKLGKPIPSTEPNVVSQATSSTAVSASKPTASPSSIAANNCTVNTSSIATSSMKGLTTTGNSSLNSTSNTKVSAVPTNMAAKKTSTPKINFVGGNKLQSTGNKAEDIKGTECVKSTPVTSAVQIPEVKQDTVSEPVTPASLAALQSDVQPVGHDYVEEVRNDEGKVIRFHCKLCECSFNDPNAKEMHLKGRRHRLQYKKKVNPDLQVEVKPSIRARKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 843289 - protein, 1074 aa, Homo sapiens [sequence omitted]

SEQ ID NO: 843290 - protein, 1074 aa, Homo sapiens [sequence omitted]

SEQ ID NO: 843291 - protein, 66 aa, Homo sapiens
LSFKSINSSLSLLRFLLLWMLKRMDPLPQMSQRFNIHNNRKRRRDSDGVDGFEAEGKKDKKDYDNF

SEQ ID NO: 843292 - protein, 608 aa, Homo sapiens
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPTATAAAVAAAAQPQPSVAETYYQTAPKAGYSQGATQYTQAQQTRQVTAIKPATPSPATTTFSIYPVSSTVQPVAAAATVVPSYTQSATYSTTAVTYSGTSYSGYEAAVYSAASSYYQQQQQQQKQAAAAAAAAAATAAWTGTTFTKKAPFQNKQLKPKQPPKPPQIHYCDVCKISCAGPQTYKEHLEGQKHKKKEAALKASQNTSSSNSSTRGTQNQLRCELCDVSCTGADAYAAHIRGAKHQKVVKLHTKLGKPIPSTEPNVVSQATSSTAVSASKPTASPSSIAANNCTVNTSSIATSSMKGLTTTGNSSLNSTSNTKVSAVPTNMAAKKTSTPKINFVGGNKLQSTGNKAEDIKGTECVKSTPVTSAVQIPEVKQDTVSEPVTPASLAALQSDVQPVGHDYVEEVRNDEGKVIRFHCKLCECSTGAGLQLNCGGCWLHRQQ

SEQ ID NO: 843293 - protein, 140 aa, Homo sapiens
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPLLPAPPPPPPR

SEQ ID NO: 843294 - protein, 1074 aa, Homo sapiens [sequence omitted]

SEQ ID NO: 843295 - protein, 715 aa, Homo sapiens
ARGPEEEGGGDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMRESHDYVEEVRNDEGKVIRFHCKLCECSFNDPNAKEMHLKGRRHRLQYKKKVNPDLQVEVKPSIRARKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 843296 - protein, 514 aa, Homo sapiens
MMILEFFFHTKVRNDEGKVIRFHCKLCECSFNDPNAKEMHLKGRRHRLQYKKKVNPDLQVEVKPSIRARKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 843297 - protein, 881 aa, Homo sapiens
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPTATAAAVAAAAQPQPSVAETYYQTAPKAGYSQGATQYTQAQQTRQVTAIKPATPSPATTTFSIYPVSSTVQPVAAAATVVPSYTQSATYSTTAVTYSGTSYSGYEAAVYSAASSYYQQQQQQQKQAAAAAAAAAATAAWTGTTFTKKAPFQNKQLKPKQPPKPPQIHYCDVCKISCAGPQTYKEHLEGQKHKKKEAALKASQNTSSSNSSTRGTQNQLRCELCDVSCTGADAYAAHIRGAKHQKVVKLHTKLGKPIPSTEPNVVSQATSSTAVSASKPTASPSSIAANNCTVNTSSIATSSMKGLTTTGNSSLNSTSNTKVSAVPTNMAAKKTSTPKINFVGGNKLQSTGNKAEDIKGTECVKSTPVTSAVQIPEVKQDTVSEPVTPASLAALQSDVQPVGHDYVEEVRNDEGKVIRFHCKLCECSFNDPNAKEMHLKGRRHRLQYKKKVNPDLQVEVKPSIRARKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGG

SEQ ID NO: 843298 - protein, 1074 aa, Homo sapiens [sequence omitted]

SEQ ID NO: 843299 - protein, 352 aa, Homo sapiens
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPTATAAAVAAAAQPQPSVAETYYQTAPKAGYSQGATQYTQAQQTRQVTAIKPATPSPATTTFSIYPVSSTVQPVAAAATVVPSYTQSATYSTTAVTYSGTSYSGYEAAVYSAASSYYQQQQQQQKQAAAAAAAAAATAAWTGTTFTKKAPFQNKQLKPKQPPKPPQIHYCDVCKISCAGPQVLTLYVLP

SEQ ID NO: 843300 - protein, 168 aa, Homo sapiens
MKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEY

SEQ ID NO: 843301 - protein, 255 aa, Homo sapiens
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEY

SEQ ID NO: 843302 - protein, 255 aa, Homo sapiens; identical to SEQ ID NO: 843301

SEQ ID NO: 843303 - protein, 279 aa, Homo sapiens
TRSSAARRWRKRGGKSAGLRDGEKMASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEY

SEQ ID NO: 843304 - protein, 255 aa, Homo sapiens; identical to SEQ ID NO: 843301

SEQ ID NO: 843305 - protein, 118 aa, Homo sapiens
MSGMKWSDERARRRWREAENLMHILEAKSTRLADGLKAEDFAIEKSLAFQSLQFGNQPTNQSTNQPTNQLLNRSTDSSRRQRLENCLNLVQRLKQSNTVSCTDLNSVKTVPHAVGSQP

SEQ ID NO: 843306 - protein, 251 aa, Homo sapiens
CEKVFSQSSSLTLHQRIHTGEKPYKCIECGKAFSQRSNLVQHQRIHTGEKPYECKECRKAFSQNAHLVQHLRVHTGEKPYECKVCRKAFSQFAYLAQHQRVHTGEKPYECIECGKAFSNRSSIAQHQRVHTGEKPYECNVCGKAFSLRAYLTVHQRIHTGERPYECKECGKAFSQNSHLAQHQRIHTGEKPYKCQECRKAFSQIAYLAQHQRVHTGEKPYECIECGKAFSNDSSLTQHQRVHTGEKPYECT

SEQ ID NO: 843307 - protein, 60 aa, Homo sapiens
NSCLMRWKVQVNSLMVLPSLTVCYSTHLSTGCRHIKVNVQVLENIQRILNVQNSEKQIYA

SEQ ID NO: 843308 - protein, 322 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFHVEGFALVLGASFIGGIRWTLTQMLLQKGELGLQNSIDTMFHLQPLMFLGLFPLFAVFGRSPLSTSENIFRSQEPACSAGTELFWGDAALVGGSRAPRSPELSSSFMPGFRSCLVGARGHNRSRGGSLARESPVPTSVGRLVPLPSREIVATTPHLCCLVR

SEQ ID NO: 843309 - protein, 322 aa, Homo sapiens; identical to SEQ ID NO: 843308

SEQ ID NO: 843310 - protein, 1230 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 843311 - protein, 1230 aa, Homo sapiens; identical to SEQ ID NO: 843310

SEQ ID NO: 843312 - protein, 908 aa, Homo sapiens
MDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 843313 - protein, 1230 aa, Homo sapiens; identical to SEQ ID NO: 843310

SEQ ID NO: 843314 - protein, 1230 aa, Homo sapiens; identical to SEQ ID NO: 843310

SEQ ID NO: 843315 - protein, 1197 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFEMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 843316 - protein, 560 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKAHHMPEAQWLRL

SEQ ID NO: 843317 - protein, 1230 aa, Homo sapiens; identical to SEQ ID NO: 843310

SEQ ID NO: 843318 - protein, 163 aa, Homo sapiens
DTHNQTRIPLTYGWYEARVECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 843319 - protein, 679 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKPEQCCIYLPCIF

SEQ ID NO: 843320 - protein, 184 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGKQEHIFLPISFCVEVFLPTLFSPSGQGGREVAVLTDVHRNPFGQLRKLKREALFSLEINVK

SEQ ID NO: 843321 - protein, 141 aa, Homo sapiens
RRRRALAFCPRERVRSEWERDGPEWKCLAPRRGPSVRPAAHELVLTRTAPSLGWLCSLGLPRDRPTPRQGGGSPSRRLPSQRRRRAATLEAGAAASERRSSSGGGGGGSGSGQQLQQRQQAGSRPSTWRAPRTTFPICWKK

SEQ ID NO: 843322 - protein, 269 aa, Homo sapiens
MASASYHISNLLEKMTSSDKDFRFMAQQCICMHGHCSKAFHQVGMHASVHKAQVSAHTCISCTVPLRTASTHMRSRYQHISSIVNSIVLASPFECSSTGAPRTSPTAHPAQHIVDASQPHTIGPAFNSDWGRFSTSSLHHATAEKLSFGHENEFLPTSLTLRGSISDTKQGTTLSGQATTLPIHKDSYSAQRWRPIQSDHHLNDRLAHHTWHQMAYTTIRHFHRYETPGFPYTTQQGRPQISALKQPNGGKRTWLRSLGYPKAFSNNPH

SEQ ID NO: 843323 - protein, 1230 aa, Homo sapiens; identical to SEQ ID NO: 843310

SEQ ID NO: 843324 - protein, 1037 aa, Homo sapiens
PVGSTIINICLKYLTYDPNYNYDDEDEDENEWDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 843325 - protein, 1230 aa, Homo sapiens; identical to SEQ ID NO: 843310

SEQ ID NO: 843326 - protein, 1136 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKVRCLCLFIQCFRRRLC

SEQ ID NO: 843327 - protein, 1230 aa, Homo sapiens; identical to SEQ ID NO: 843310

SEQ ID NO: 843328 - protein, 573 aa, Homo sapiens
TDVMSCEAGLVGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 843329 - protein, 1230 aa, Homo sapiens; identical to SEQ ID NO: 843310

SEQ ID NO: 843330 - protein, 451 aa, Homo sapiens
LPLLEHALKRDQHGFKRMVSLFNRLIKVTQRIIQSLPKYPGPSCKGHALSRVSITWGTETGSSATSVTSGDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 843331 - protein, 110 aa, Homo sapiens
MLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 843332 - protein, 141 aa, Homo sapiens; identical to SEQ ID NO: 843321

SEQ ID NO: 843333 - protein, 424 aa, Homo sapiens
WEVLSRLIYSGPRGEGARTPRGLSSPACPFQRPRPRSMPRPRLLAALCGALLCAPSLLVALDICSKNPCHNGGLCEEISQEVRGDVFPSYTCTCLKGYAGNHCETKCVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 843334 - protein, 372 aa, Homo sapiens
WEVLSRLIYSGPRGEGARTPRGLSSPACPFQRPRPRSMPRPRLLAALCGALLCAPSLLVALDICSKNPCHNGGLCEEISQEVRGDVFPSYTCTCLKGYAGNHCETKCVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQIFPGNWDNHSHKKNLFETPILARYVRILPVAWHNRIALRLELLGC

SEQ ID NO: 843335 - protein, 424 aa, Homo sapiens; identical to SEQ ID NO: 843333

SEQ ID NO: 843336 - protein, 424 aa, Homo sapiens; identical to SEQ ID NO: 843333

SEQ ID NO: 843337 - protein, 424 aa, Homo sapiens; identical to SEQ ID NO: 843333

SEQ ID NO: 843338 - protein, 424 aa, Homo sapiens; identical to SEQ ID NO: 843333

SEQ ID NO: 843339 - protein, 424 aa, Homo sapiens; identical to SEQ ID NO: 843333

SEQ ID NO: 843340 - protein, 333 aa, Homo sapiens
WEVLSRLIYSGPRGEGARTPRGLSSPACPFQRPRPRSMPRPRLLAALCGALLCAPSLLVALDICSKNPCHNGGLCEEISQEVRGDVFPSYTCTCLKGYAGNHCETKCVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNARPGACISSAGTPPMHGWTSRATSTPGLRGATVTISGCRSSLATGTTTPTRRTCLRRPSWLAMCASCL

SEQ ID NO: 843341 - protein, 95 aa, Homo sapiens
VGGAEPPDLFRSQRRRRQNPAGSEQPSVPIPAPASPQHAAPPPAGRAVRRAALRPQPPRRPGYLFQKPLPQRWFMRGDFPRSARRCLPLVHLHVP

SEQ ID NO: 843342 - protein, 275 aa, Homo sapiens
WEVLSRLIYSGPRGEGARTPRGLSSPACPFQRPRPRSMPRPRLLAALCGALLCAPSLLVALDICSKNPCHNGGLCEEISQEVRGDVFPSYTCTCLKGYAGNHCETKCVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGKLPQVSTDN

SEQ ID NO: 843343 - protein, 220 aa, Homo sapiens
MVASRKARKRQAGDNSLLPVGPASALGYPCGHNCCGPLSPRHFPLSPWLPLLPLVLKPSDTEGGGAGLWGERERGQRRAWVGRVGVWGPLCWLFTPEDTGSFQNIFIFFTGKKKKKKKKKKKKKKEEGGARAPKPPPPPPPPPPPPLFCKGGPPKGRRIIKQRRGERGARGLKNTRDQWRRTTGGTTGGTPSGEKRHTQLRGGGGEPQGGEHKHPQGGLL

SEQ ID NO: 843344 - protein, 110 aa, Homo sapiens
MVASRKARKRQAGDNSLLPVGPASALGYPCGHNCCGPLSPRHFPLSPWLPLLPLVLKPSDTEGGGAGLWGERERGQRRAWVGRVGVWGPLCWLFTPEDTGSFQNIFIFFT

SEQ ID NO: 843345 - protein, 424 aa, Homo sapiens; identical to SEQ ID NO: 843333

SEQ ID NO: 843346 - protein, 424 aa, Homo sapiens; identical to SEQ ID NO: 843333

SEQ ID NO: 843347 - protein, 424 aa, Homo sapiens; identical to SEQ ID NO: 843333

SEQ ID NO: 843348 - protein, 424 aa, Homo sapiens; identical to SEQ ID NO: 843333

SEQ ID NO: 843349 - protein, 380 aa, Homo sapiens
WEVLSRLIYSGPRGEGARTPRGLSSPACPFQRPRPRSMPRPRLLAALCGALLCAPSLLVALECVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 843350 - protein, 145 aa, Homo sapiens
FPVKKINIFWKLPVSSGVKSQHSEPGYRQDAHIAAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 843351 - protein, 283 aa, Homo sapiens
WEVLSRLIYSGPRGEGARTPRGLSSPACPFQRPRPRSMPRPRLLAALCGALLCAPSLLVALDICSKNPCHNGGLCEEISQEVRGDVFPSYTCTCLKGYAGNHCETKCVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNDAPIPGPEGLPSRDPLDP

SEQ ID NO: 843352 - protein, 103 aa, Homo sapiens
VGGAEPPDLFRSQRRRRQNPAGSEQPSVPIPAPASPQHAAPPPAGRAVRRAALRPQPPRRPGGISAFQPEGPVCSYQMLPTLGELSGMSAHGPFQPSSSRNWN

SEQ ID NO: 843353 - protein, 212 aa, Homo sapiens
NLPGVPSPGSNARMPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVEDYLLKIIDTPGLLKPEQVSALFGNIENIYALNSSQEFDIYTQYCNNYPNSVAALTECMRDKQQAKFFRDRQELLQHSLPLGS

SEQ ID NO: 843354 - protein, 169 aa, Homo sapiens
EAPPGAPSRPLDRGSSRLDRSYSYSYSNGPGPFYNKGLISEEELGASVASLSSENPYATIRDLPSLPGGPRESSYMEMKGPPSGSPPRQPPQFWDSQRRRQPQPQRDSGTYEQPSPLIHDRDSVGSQPPLPPGLPPGHYDSPKNSHIPGHYDLPPVRHPPSPPLRRQDR

SEQ ID NO: 843355 - protein, 169 aa, Homo sapiens; identical to SEQ ID NO: 843354

SEQ ID NO: 843356 - protein, 152 aa, Homo sapiens
TILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTAPTRKPLTNKVTAGTSSTTP

SEQ ID NO: 843357 - protein, 157 aa, Homo sapiens
MSGSLGRAAAALLRWGRGAGGGGLWGPGVRAAGSGAGGGGSAEQLDALVKKDKVVVFLKGTPEQPQCGFSNAVVQILRLHGVRDYAAYNVLDDPELRQGIKDYSNWPTIPQVYLNGEFVGGCDILLQMHQNGDLVEELKKLGIHSALLDEKKDQDSK

SEQ ID NO: 843358 - protein, 52 aa, Homo sapiens
MKRKTKTPSEGGQVLAEQRGSRSCQRLTARKALPILVFTIETATACTDHFGS

SEQ ID NO: 843359 - protein, 52 aa, Homo sapiens; identical to SEQ ID NO: 843358

SEQ ID NO: 843360 - protein, 157 aa, Homo sapiens; identical to SEQ ID NO: 843357

SEQ ID NO: 843361 - protein, 157 aa, Homo sapiens; identical to SEQ ID NO: 843357

SEQ ID NO: 843362 - protein, 52 aa, Homo sapiens; identical to SEQ ID NO: 843358

SEQ ID NO: 843363 - protein, 257 aa, Homo sapiens
MPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVPYCIIKGKARLGRLVHRKTCTTVAFTQVNSEDKGALAKLVEAIRTNYNDRYDEIRRHWGGNVLGPKSVARIAKLEKAR

SEQ ID NO: 843364 - protein, 257 aa, Homo sapiens; identical to SEQ ID NO: 843363

SEQ ID NO: 843365 - protein, 123 aa, Homo sapiens
IFIIYCRHLEISVLISNYGTCSLNGHEVTIRTIFRMSLLDASSLKPYDSFLLAVLFLTRDNKGFASQVCMAKKVSTSVNGSFLMTSQQPLVKDVIEIVQRLGSVCFVLLLKSFHGSKLFLSIV

SEQ ID NO: 843366 - protein, 80 aa, Homo sapiens
LRIPTSTDAFSLQLEMVYNMTVWNVKRKQDIEEGAPPQVRKEPGRETSVNTPEEKMDIGKPNAQILINEARASWAPTIIN

SEQ ID NO: 843367 - protein, 171 aa, Homo sapiens
GSTHLSISGINIYEPAPPTGPTQRPLETLGNFRGWYIRTEKLQQNQSWTVKQQCVDLLAEGLWEELLDDEQPAITVMDWFEDSRLDACVYELHVWLLAADRRTVIAQHHVAPRTSGRGPPGRWVQVSHVFRHYGPGVRFIHFLHKAKNRMEPGGLRRTRVTDSSVSVQLRE

SEQ ID NO: 843368 - protein, 214 aa, Homo sapiens
AGWGRRRAGPAGSSGYRAGYSSSTPHDANMAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGREVSPAHQYALAGGISFPFFWLAGAGSAVFWVLGATLVVIGSHAAFHQIEAVDGEELQMEPV

SEQ ID NO: 843369 - protein, 185 aa, Homo sapiens
MAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGREVSPAHQYALAGGISFPFFWLAGAGSAVFWVLGATLVVIGSHAAFHQIEAVDGEELQMEPV

SEQ ID NO: 843370 - protein, 241 aa, Homo sapiens
MAKVRPGVNSAPRRKHGSAEGPAERCRGGRAERHVSELALGPRTRDPGVRAPGPLLPPPSRAWSPSPEPQKCWPRTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGREVSPAHQYALAGGISFPFFWLAGAGSAVFWVLGATLVVIGSHAAFHQIEAVDGEELQMEPV

SEQ ID NO: 843371 - protein, 186 aa, Homo sapiens
AGWGRRRAGPAGSSGYRAGYSSSTPHDANMAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGREVSPAHQYALAGGISFPFFWLAGAGSAVFWVLD

SEQ ID NO: 843372 - protein, 151 aa, Homo sapiens
MAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGATLVVIGSHAAFHQIEAVDGEELQMEPV

SEQ ID NO: 843373 - protein, 154 aa, Homo sapiens
MTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGEKPPAQMNPWSLKSWSFGMQTDLRPQIQVLQNPSPPKPRCTLDPPNLIP

SEQ ID NO: 843374 - protein, 185 aa, Homo sapiens; identical to SEQ ID NO: 843369

SEQ ID NO: 843375 - protein, 85 aa, Homo sapiens
SLTLEDPPRLVALAVFFGACYILYLRTLESKLVLFGEKPPAQMNPWSLKSWSFGMQTDLRPQIQVLQNPSPPKPRCTLDPPNLIP

SEQ ID NO: 843376 - protein, 214 aa, Homo sapiens; identical to SEQ ID NO: 843368

SEQ ID NO: 843377 - protein, 139 aa, Homo sapiens
MAAQKDQQKDAEAEGLSGTTLLPKLIPSGAGREWLERRRATIRPWSTFVDQQRFSRPRNLGELCQRLVRNVEYYQSNYVFVFLGLILYCVPRGEPSASVCSGWRHLLPLLLAGWCGLGRLLGAGSHPGGHRLPRCLPPD

SEQ ID NO: 843378 - protein, 172 aa, Homo sapiens
MAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGEKPPAQMNPWSLKSWSFGMQTDLRPQIQVLQNPSPPKPRCTLDPPNLIP

SEQ ID NO: 843379 - protein, 73 aa, Homo sapiens
AQRISMLWLEASPSPSSGWLVRARPSSGCWVSTGSEQLGWMVGARCRSVALSCRLSCRSHPGGHRLPRCLPPD

SEQ ID NO: 843380 - protein, 953 aa, Homo sapiens
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSHMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNMVDLNDYLQHILKSTNMKCLTPEKALSGYCGFMAANLYARSIFGEDALANVSIEKPIHQGPDAAVTGHIRIRAKSQGMALSLGDKINLSQKKTSI

SEQ ID NO: 843381 - protein, 953 aa, Homo sapiens; identical to SEQ ID NO: 843380

SEQ ID NO: 843382 - protein, 953 aa, Homo sapiens; identical to SEQ ID NO: 843380

SEQ ID NO: 843383 - protein, 935 aa, Homo sapiens
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIMRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSHMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNMVDLNDYLQHILKSTNMKCLTPEKALSGYCGFMAANLYARSIFGEDALANVSIEKPIHQGPDAAVTGHIRIRAKSQGMALSLGDKINLSQKKTSI

SEQ ID NO: 843384 - protein, 935 aa, Homo sapiens
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSHMLSAKLEEEKLSQKMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNMVDLNDYLQHILKSTNMKCLTPEKALSGYCGFMAANLYARSIFGEDALANVSIEKPIHQGPDAAVTGHIRIRAKSQGMALSLGDKINLSQKKTSI

SEQ ID NO: 843385 - protein, 937 aa, Homo sapiens
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSHMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKILKSTNMKCLTPEKALSGYCGFMAANLYARSIFGEDALANVSIEKPIHQGPDAAVTGHIRIRAKSQGMALSLGDKINLSQKKTSI

SEQ ID NO: 843386 - protein, 953 aa, Homo sapiens; identical to SEQ ID NO: 843380

SEQ ID NO: 843387 - protein, 946 aa, Homo sapiens [sequence omitted]

SEQ ID NO: 843388 - protein, 886 aa, Homo sapiens
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSHMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNMVDLNDYLQHILKSTNMKCLTPEKVKFD

SEQ ID NO: 843389 - protein, 516 aa, Homo sapiens
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKDVESKLKQHQVPTVVTFLIKI

SEQ ID NO: 843390 - protein, 953 aa, Homo sapiens; identical to SEQ ID NO: 843380

SEQ ID NO: 843391 - protein, 953 aa, Homo sapiens; identical to SEQ ID NO: 843380

SEQ ID NO: 843392 - protein, 643 aa, Homo sapiens
SVNCDLTHSERGISYRLLDHMRVELRKENSVLRTEDLVSARSGEQLVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSHMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNMVDLNDYLQHILKSTNMKCLTPEKALSGYCGFMAANLYARSIFGEDALANVSIEKPIHQGPDAAVTGHIRIRAKSQGMALSLGDKINLSQKKTSI

SEQ ID NO: 843393 - protein, 840 aa, Homo sapiens
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKEAGELKPEEEITVGPVQKLVTEMGTYATQSALSSSRPTKKEEDRPPLRGFLLDGDFFVAASLATTMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNMVDLNDYLQHILKSTNMKCLTPEKALSGYCGFMAANLYARSIFGEDALANVSIEKPIHQGPDAAVTGHIRIRAKSQGMALSLGDKINLSQKKTSI

SEQ ID NO: 843394 - protein, 953 aa, Homo sapiens; identical to SEQ ID NO: 843380

SEQ ID NO: 843395 - protein, 111 aa, Homo sapiens
MWAEFEWENKVTVNTNMVDLNDYLQHILKSTNMKCLTPEKALSGYCGFMAANLYARSIFGEDALANVSIEKPIHQGPDAAVTGHIRIRAKSQGMALSLGDKINLSQKKTSI

SEQ ID NO: 843396 - protein, 138 aa, Homo sapiens
KQKVKNLWFPCISTRFVHNPPPSAKQKSDHWGHFEMEHKVPLPPTWLIKCLLTAHLRSPYIKACLKKALSGYCGFMAANLYARSIFGEDALANVSIEKPIHQGPDAAVTGHIRIRAKSQGMALSLGDKINLSQKKTSI

SEQ ID NO: 843397 - protein, 1433 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 843398 - protein, 278 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISGKTSIFYILFAFALQMSHKSTLIHWKGCFPSEYERNGLGKRFHPSCRHFRGCQF

SEQ ID NO: 843399 - protein, 391 aa, Homo sapiens
SRSAGGSERARRTLLSAPPRQRRRLGAGSGARVQRPAGAWRRGLPGEVVVSWLEPRDGRSGRGAGGGEREDGLWRPGRWPRGARAPGEQAASRSPWSATGTPGSCCARCSAVCFSQVRRGWGPGPEAGCDGAAGGQSLRGQGGVHAGRRGCSPEKLATARTWDTSCSGHAWGRCALSPRERLEEWLAWTREHQRSDGSALGLSVCDRIADPLSSCRVGVSLPRPWALRSSTHRDLPGTQSPFPEDLGQVRRVPRSREQRVLKACPGGRGLAEARGLLVFGTGRDLASSRRVYEGSRFGGDSCLRGSRRISGEGQRRHSHDPLRVPKPDCPGERFGERPAPPPPLSDRGAPVRCAQPPGWGLCREQAWCAVQSVSRTSVTLTHKGSPGPKYR

SEQ ID NO: 843400 - protein, 91 aa, Homo sapiens
RGPREARSAPGGHSSRLLPGSGGGSERAPGLGCSGQRAPGGEDYPGKWLSPFFILTFSHFSFPSSSNYITYSFFRFVRRLHLSIPLLHHFL

SEQ ID NO: 843401 - protein, 1433 aa, Homo sapiens; identical to SEQ ID NO: 843397

SEQ ID NO: 843402 - protein, 1433 aa, Homo sapiens; identical to SEQ ID NO: 843397

SEQ ID NO: 843403 - protein, 1455 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITELSNFELPSSLLSGIEFYLIGSHVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 843404 - protein, 1303 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFQLRSLIQEALMMSDM

SEQ ID NO: 843405 - protein, 821 aa, Homo sapiens
MASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 843406 - protein, 1411 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEVSCERKLRRMKMQS

SEQ ID NO: 843407 - protein, 828 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPELYTSTSPSSSSSSPLSSSSSSSSSSSS

SEQ ID NO: 843408 - protein, 1303 aa, Homo sapiens; identical to SEQ ID NO: 843404

SEQ ID NO: 843409 - protein, 119 aa, Homo sapiens [sequence omitted]

SEQ ID NO: 843410 - protein, 854 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPDQASVPDQASVPDQASVPDQASVPDQASVPDQASVPDQASVDQASVPDQASVPD

SEQ ID NO: 843411 - protein, 613 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKL

SEQ ID NO: 843412 - protein, 782 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRGEHCNKKAVFSRISKFKSTRNDCTTQSNVKH

SEQ ID NO: 843413 - protein, 1433 aa, Homo sapiens; identical to SEQ ID NO: 843397

SEQ ID NO: 843414 - protein, 1461 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKLPPATVLSCCHLQASLPTTSISFRDSKRMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 843415 - protein, 980 aa, Homo sapiens
MYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKLPPATVLSCCHLQASLPTTSISFRDSKRMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 843416 - protein, 1431 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVLVVKES

SEQ ID NO: 843417 - protein, 482 aa, Homo sapiens
LALWAACPAQACSGNAGQERGGLQSAAGLPSQPSCFLQTGVGLANQGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 843418 - protein, 206 aa, Homo sapiens
MLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 843419 - protein, 813 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGSANTAVNKKTEI

SEQ ID NO: 843420 - protein, 831 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGKRLFFLPFIISHLSSAPLSLNSPVTCFQYV

SEQ ID NO: 843421 - protein, 512 aa, Homo sapiens
IEVRGRLGARQADTPLGSSPAAAAARSGLRGSGAAASGRLAARITRGSGCLLAGAARRALRARGRRRRTRGRTLAAGSLAAGSAGTGRAGRVALTMVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEEEEFAQEEEEFAQEEEEFA

SEQ ID NO: 843422 - protein, 183 aa, Homo sapiens
ISFLIETGTLLHFPDTSHGLRNLYFLDPIWLSECLQRIFNIKGSRSVAKNGVIRAEDLRMLLVGTGFTQQTEEQYFQFLAKFEIALPVANDSYLLPHLLPSKPGLDTHGMRHPTANTIQRVFKMSFVPVGFWQRFIARMLISLAEMDLQLFENKKNTKSRNRKVTIYSFTGNQRSRCSTFRVK

SEQ ID NO: 843423 - protein, 92 aa, Homo sapiens
ISFLIETGTLLHFPDTSHGLRNLYFLDPIWLSECLQRIFNIKGSRSVAKNGVIRAEDLRMLLVGTGFTQQTEEQYFQFLAKFEIALPVANDR

SEQ ID NO: 843424 - protein, 177 aa, Homo sapiens
MPSSAVRVLEEALGMGLTAAGDARDTADAVAAEGAYYLEQVTITEASEDDYEYEEIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAAEYVIF

SEQ ID NO: 843425 - protein, 196 aa, Homo sapiens
MNMKRYQMTILASQKVKKIWQKQFRWPKNRLQILKFWYELIQKGVTELRTVGNVPDVYTQIMLLENENKNLKKDLKHYKQAADKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKVDHSREKENAPEGPT

SEQ ID NO: 843426 - protein, 129 aa, Homo sapiens
MDLQNDMIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAAEYVIF

SEQ ID NO: 843427 - protein, 276 aa, Homo sapiens
MPSSAVRVLEEALGMGLTAAGDARDTADAVAAEGAYYLEQVTITEASEDDYEYEEIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAADKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKGKCKM

SEQ ID NO: 843428 - protein, 74 aa, Homo sapiens
RCRNLARAPGGRWVASSLLPLGTAVGLLGVGARSARDGCSARDAQLRREGPGRGVGHGFDGSRGREGHGGRGGG

SEQ ID NO: 843429 - protein, 174 aa, Homo sapiens
MNMKRYQMTILASQKVKKIWQKQFRWPKNRLQILKFCKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKVASKRIKYLRIQLTKDVKDVFKENYKPLLNEVKEDTNKW

SEQ ID NO: 843430 - protein, 168 aa, Homo sapiens
MDLQNDMIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAADKAREDLLKIQKERDFHRMHHKRIVQEKNKLINDLKGFLDFKKH

SEQ ID NO: 843431 - protein, 2197 aa, Homo sapiens
DLKQTEMINILAIQNLNEILGMYLPDVDQKESDGGADLTLGLREALELIYPIPDQNDLIIMTLIVATIGAPLIERGRAILGHTQITEHERVLTQKKSIRRHTQGVPHLIPLLTVDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQKEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPQEDGLHSSEELRNLGWDFSQEKPSATYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVPSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAEMDLGTPTYDENPMKASKKPKTAEADTSSELAKKSKEVFRKEMSQFIVQCLNPYRKPDCKVGRITTTEDFKHLARKLTHGVMNKELKYCKNPEDLECNENVKHKTKEYIKKYMQKFGAVYKPKEDTELE

SEQ ID NO: 843432 - protein, 2275 aa, Homo sapiens
DLKQTEMINILAIQNLNEILGMYLPDVDQKESDGGADLTLGLREALELIYPIPDQNDLIIMTLIVATIGAPLIERGRAILGHTQITEHERVLTQKKSIRRHTQGVPHLIPLLTVDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQKEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPQEDGLHSSEELRNLGWDFSQEKPSATYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVPSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNEVKRESVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAEMDLGTPTYDENPMKASKKPKTAEADTSSELAKKSKEVFRKEMSQFIVQCLNPYRKPDCKVGRITTTEDFKHLARKLTHGVMNKELKYCKNPEDLECNENVKHKTKEYIKKYMQKFGAVYKPKEDTELE

SEQ ID NO: 843433 - protein, 98 aa, Homo sapiens
ATSVTTEVQKEMSQFIVQCLNPYRKPDCKVGRITTTEDFKHLARKLTHGVMNKELKYCKNPEDLECNENVKHKTKEYIKKYMQKFGAVYKPKEDTELE

SEQ ID NO: 843434 - protein, 2197 aa, Homo sapiens; identical to SEQ ID NO: 843431

SEQ ID NO: 843435 - protein, 2212 aa, Homo sapiens
DLKQTEMINILAIQNLNEILGMYLPDVDQKESDGGADLTLGLREALELIYPIPDQNDLIIMTLIVATIGAPLIERGRAILGHTQITEHERVLTQKKSIRRHTQGVPHLIPLLTVDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQKEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPQEDGLHSSEELRNLGWDFSQEKPSATYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVPSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRDRVFLCCPELICTNSWLQAILPPEASQNAGMTGVRHHTQLQLQTQWDPPTWESPGDDASLEHEAEMDLGTPTYDENPMKASKKPKTAEADTSSELAKKSKEVFRKEMSQFIVQCLNPYRKPDCKVGRITTTEDFKHLARKVLPLLLVAHQAMFWANCVPSKKPFSS

SEQ ID NO: 843436 - protein, 2147 aa, Homo sapiens
DLKQTEMINILAIQNLNEILGMYLPDVDQKESDGGADLTLGLREALELIYPIPDQNDLIIMTLIVATIGAPLIERGRAILGHTQITEHERVLTQKKSIRRHTQGVPHLIPLLTVDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQKEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPQEDGLHSSEELRNLGWDFSQEKPSATYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVPSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAEMDLGTPTYDENPMKASKKPKTAEADTSSELAKKSKEVFRKEMSQFIVQCLNPYRKHPGATDFHSSSTRSGGTASRSSD

SEQ ID NO: 843437 - protein, 2279 aa, Homo sapiens [sequence omitted]

SEQ ID NO: 843438 - protein, 2279 aa, Homo sapiens [sequence omitted]

SEQ ID NO: 843439 - protein, 1325 aa, Homo sapiens
MFWTDWGDLKPGIYRSNMDGSAAYHLVSEDVKWPNGISVDDQWIYWTDAYLECIERITFSGQQRSVILDNLPHPYAIAVFKNEIYWDDWSQLSIFRASKYSGSQMEILANQLTGLMDMKIFYKGKNTGSNACVPRPCSLLCLPKANNSRSCRCPEDVSSSVLPSGDLMCDCPQGYQLKNNTCVKEENTCLRNQYRCSNGNCINSIWWCDFDNDCGDMSDERNCPTTICDLDTQFRCQESGTCIPLSYKCDLEDDCGDNSDESHCEMHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAIAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 843440 - protein, 571 aa, Homo sapiens
NLGPGKKSQKDCIELSRPTLCQYASLGSSVPPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAIAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 843441 - protein, 446 aa, Homo sapiens [sequence omitted]

SEQ ID NO: 843442 - protein, 1213 aa, Homo sapiens
AASTVFPLAWLSLILWGFSLGAGPRISQRWYFGDTCLHLTEPALLASRCTFSPGGGATCSSVRPNMATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYIFADAYAQYLWITFDFCNTLQGFSIPFRAADLLLHSKASNLLLGFDRSHPNKQLWKSDDFGQTWIMIQEHVKSFSWGIDPYDKPNTIYIERHEPSGYSTVFRSTDFFQSRENQEVILEEVRDFQLRDKYMFATKVVHLLGSEQQSSVQLWVSFGRKPMRAAQFVTRHPINEYYIADASEDQVFVCVSHSNNRTNLYISEAEGLKFSLSLENVLYYSPGGAGSDTLVRYFANEPFADFHRVEGLQGVYIATLINGSMNEENMRSVITFDKGGTWEFLQAPAFTGYGEKINCELSQGCSLHLAQRLSQLLNLQLRRMPILSKESAPGLIIATGSVGKNLASKTNVYISSSAGARWREALPGPHYYTWGDHGGIITAIAQGMETNELKYSTNEGETWKTFIFSEKPVFVYGLLTEPGEKSTVFTIFGSNKENVHSWLILQVNATDALGVPCTENDYKLWSPSDERGNECLLGHKTVFKRRTPHATCFNGEDFDRPVVVSNCSCTREDYECDFGFKMSEDLSLEVCVPDPEFSGKSYSPPVPCPVGSTYRRTRGYRKISGDTCSGGDVEARLEGELVPCPLAEENEFILYAVRKSIYRYDLASGATEQLPLTGLRAAVALDFDYEHNCLYWSDLALDVIQRLCLNGSTGQEVIINSGLETVEALAFEPLSQLLYWVDAGFKKIEVANPDGDFRLTIVNSSVLDRPRALVLVPQEGVMFWTDWGDLKPGIYRSNMDGSAAYHLVSEDVKWPNGISVDDQWIYWTDAYLECIERITFSGQQRSVILDNLPHPYAIAVFKNEIYWDDWSQLSIFRASKYSGSQMEILANQLTGLMDMKIFYKGKNTGSNACVPRPCSLLCLPKANNSRSCRCPEDVSSSVLPSGDLMCDCPQGYQLKNNTCVKEENTCLRNQYRCSNGNCINSIWWCDFDNDCGDMSDERNCRESSGLDVKHLPLLRSLVGSSQAEGLRSRARATHDW

SEQ ID NO: 843443 - protein, 753 aa, Homo sapiens
AASTVFPLAWLSLILWGFSLGAGPRISQRWYFGDTCLHLTEPALLASRCTFSPGGGATCSSVRPNMATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYIFADAYAQYLWITFDFCNTLQGFSIPFRAADLLLHSKASNLLLGFDRSHPNKQLWKSDDFGQTWIMIQEHVKSFSWGIDPYDKPNTIYIERHEPSGYSTVFRSTDFFQSRENQEVILEEVRDFQLRDKYMFATKVVHLLGSEQQSSVQLWVSFGRKPMRAAQFVTRHPINEYYIADASEDQVFVCVSHSNNRTNLYISEAEGLKFSLSLENVLYYSPGGAGSDTLVRYFANEPFADFHRVEGLQGVYIATLINGSMNEENMRSVITFDKGGTWEFLQAPAFTGYGEKINCELSQGCSLHLAQRLSQLLNLQLRRMPILSKESAPGLIIATGSVGKNLASKTNVYISSSAGARWREALPGPHYYTWGDHGGIITAIAQGMETNELKYSTNEGETWKTFIFSEKPVFVYGLLTEPGEKSTVFTIFGSNKENVHSWLILQVNATDALGVPCTENDYKLWSPSDERGNECLLGHKTVFKRRTPHATCFNGEDFDRPVVVSNCSCTREDYEWSVLL

SEQ ID NO: 843444 - protein, 226 aa, Homo sapiens
ARAAWSPGSGARGPGPAALLASRCTFSPGGGATCSSVRPNMATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYFADAPYGSR

SEQ ID NO: 843445 - protein, 2279 aa, Homo sapiens [sequence omitted]

SEQ ID NO: 843446 - protein, 1875 aa, Homo sapiens
AASTVFPLAWLSLILWGFSLGAGPRISQRWYFGDTCLHLTEPALLASRCTFSPGGGATCSSVRPNMATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYIFADAYAQYLWITFDFCNTLQGFSIPFRAADLLLHSKASNLLLGFDRSHPNKQLWKSDDFGQTWIMIQEHVKSFSWGIDPYDKPNTIYIERHEPSGYSTVFRSTDFFQSRENQEVILEEVRDFQLRDKYMFATKVVHLLGSEQQSSVQLWVSFGRKPMRAAQFVTRHPINEYYIADASEDQVFVCVSHSNNRTNLYISEAEGLKFSLSLENVLYYSPGGAGSDTLVRYFANEPFADFHRVEGLQGVYIATLINGSMNEENMRSVITFDKGGTWEFLQAPAFTGYGEKINCELSQGCSLHLAQRLSQLLNLQLRRMPILSKESAPGLIIATGSVGKNLASKTNVYISSSAGARWREALPGPHYYTWGDHGGIITAIAQGMETNELKYSTNEGETWKTFIFSEKPVFVYGLLTEPGEKSTVFTIFGSNKENVHSWLILQVNATDALGVPCTENDYKLWSPSDERGNECLLGHKTVFKRRTPHATCFNGEDFDRPVVVSNCSCTREDYECDFGFKMSEDLSLEVCVPDPEFSGKSYSPPVPCPVGSTYRRTRGYRKISGDTCSGGDVEARLEGELVPCPLAEENEFILYAVRKSIYRYDLASGATEQLPLTGLRAAVALDFDYEHNCLYWSDLALDVIQRLCLNGSTGQEVIINSGLETVEALAFEPLSQLLYWVDAGFKKIEVANPDGDFRLTIVNSSVLDRPRALVLVPQEGVMFWTDWGDLKPGIYRSNMDGSAAYHLVSEDVKWPNGISVDDQWIYWTDAYLECIERITFSGQQRSVILDNLPHPYAIAVFKNEIYWDDWSQLSIFRASKYSGSQMEILANQLTGLMDMKIFYKGKNTGSNACVPRPCSLLCLPKANNSRSCRCPEDVSSSVLPSGDLMCDCPQGYQLKNNTCVKEENTCLRNQYRCSNGNCINSIWWCDFDNDCGDMSDERNCPTTICDLDTQFRCQESGTCIPLSYKCDLEDDCGDNSDESHCEMHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVMWEFQASSWMGLYFVWELKGHSTVRLEKNKKQLPP

SEQ ID NO: 843447 - protein, 1278 aa, Homo sapiens
AASTVFPLAWLSLILWGFSLGAGPRISQRWYFGDTCLHLTEPALLASRCTFSPGGGATCSSVRPNMATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYIFADAYAQYLWITFDFCNTLQGFSIPFRAADLLLHSKASNLLLGFDRSHPNKQLWKSDDFGQTWIMIQEHVKSFSWGIDPYDKPNTIYIERHEPSGYSTVFRSTDFFQSRENQEVILEEVRDFQLRDKYMFATKVVHLLGSEQQSSVQLWVSFGRKPMRAAQFVTRHPINEYYIADASEDQVFVCVSHSNNRTNLYISEAEGLKFSLSLENVLYYSPGGAGSDTLVRYFANEPFADFHRVEGLQGVYIATLINGSMNEENMRSVITFDKGGTWEFLQAPAFTGYGEKINCELSQGCSLHLAQRLSQLLNLQLRRMPILSKESAPGLIIATGSVGKNLASKTNVYISSSAGARWREALPGPHYYTWGDHGGIITAIAQGMETNELKYSTNEGETWKTFIFSEKPVFVYGLLTEPGEKSTVFTIFGSNKENVHSWLILQVNATDALGVPCTENDYKLWSPSDERGNECLLGHKTVFKRRTPHATCFNGEDFDRPVVVSNCSCTREDYECDFGFKMSEDLSLEVCVPDPEFSGKSYSPPVPCPVGSTYRRTRGYRKISGDTCSGGDVEARLEGELVPCPLAEENEFILYAVRKSIYRYDLASGATEQLPLTGLRAAVALDFDYEHNCLYWSDLALDVIQRLCLNGSTGQEVIINSGLETVEALAFEPLSQLLYWVDAGFKKIEVANPDGDFRLTIVNSSVLDRPRALVLVPQEGVMFWTDWGDLKPGIYRSNMDGSAAYHLVSEDVKWPNGISVDDQWIYWTDAYLECIERITFSGQQRSVILDNLPHPYAIAVFKNEIYWDDWSQLSIFRASKYSGSQMEILANQLTGLMDMKIFYKGKNTGSNACVPRPCSLLCLPKANNSRSCRCPEDVSSSVLPSGDLMCDCPQGYQLKNNTCVKEENTCLRNQYRCSNGNCINSIWWCDFDNDCGDMSDERNCPTTICDLDTQFRCQESGTCIPLSYKCDLEDDCGDNSDESHCEMHQCRSDEYNCSSGMCIRSSWVCDGDNDCRDWSDEANCTGQYFLDSVDSTHPFMQWLTL

SEQ ID NO: 843448 - protein, 128 aa, Homo sapiens
RDPPSLASQSAGITGMSHRSSSVTEAGAQWHNQLTASSASTSASLQPLLGSSDTPASASQVAGTTDTDHHAQLIFVYFVEMGFCHVAQAFKLLSSSDPPTLASQSDGIIGMSHCAWSVYKFYSFRYYV

SEQ ID NO: 843449 - protein, 114 aa, Homo sapiens
MLLTSVSTNSASKGKEDPAEFRDLLSNFLQLLYVSKSEPPKSESMGLLALWLPGEFSQWNHGRRSEGGNTMRSRNVFPWFLPCSITAVGMYLSQTSYLLLHYSLHRALFYLGLQ

SEQ ID NO: 843450 - protein, 326 aa, Homo sapiens
AEYGKREGQIANVWSLVSRLPFLGALGVAVAVAEIGCTMSAFEKPQIIAHIQKGFNYTVFDCKWVPCSAKFVTMGNFARGTGVIQLYEIQHGDLKLLREIEKAKPIKCGTFGATSLQQRYLATGDFGGNLHIWNLEAPEMPVYSVKGHKEIINAIDGIGGLGIGEGAPEIVTGSRDGTVKVWDPRQKDDPVANMEPVQGENKRDCWTVAFGNAYNQEERVVCAGYDNGDIKLFDLRNMALRWETNIKNGVCSLEFDRKDISMNKLVATSLEGKFHVFDMRTQHPTKGFASVSEKAHKSTVWQVRHLPQNRELFLTAGGAGGLHLWK

SEQ ID NO: 843451 - protein, 395 aa, Homo sapiens
AEYGKREGQIANVWSLVSRLPFLGALGVAVAVAEIGCTMSAFEKPQIIAHIQKGFNYTVFDCKWVPCSAKFVTMGNFARGTGVIQLYEIQHGDLKLLREIEKAKPIKCGTFGATSLQQRYLATGDFGGNLHIWNLEAPEMPVYSVKGHKEIINAIDGIGGLGIGEGAPEIVTGSRDGTVKVWDPRQKDDPVANMEPVQGENKRDCWTVAFGNAYNQEERVVCAGYDNGDIKLFDLRNMALRWETNIKNGVCSLEFDRKDISMNKLVATSLEGKFHVFDMRTQHPTKGFASVSEKAHKSTVWQVRHLPQNRELFLTAGGAGGLHLWKYEYPIQRSKKDSEGIEMGVAGSVSLLQNVTLSTQPISSLDWSPDKRGLCVCSSFDQTVRVLIVTKLNKI

SEQ ID NO: 843452 - protein, 395 aa, Homo sapiens; identical to SEQ ID NO: 843451

SEQ ID NO: 843453 - protein, 326 aa, Homo sapiens; identical to SEQ ID NO: 843450

SEQ ID NO: 843454 - protein, 326 aa, Homo sapiens; identical to SEQ ID NO: 843450

SEQ ID NO: 843455 - protein, 306 aa, Homo sapiens
AEYGKREGQIANVWSLVSRLPFLGALGVAVAVAEIGCTMSAFEKPQIIAHIQKGFNYTVFDCKWVPCSAKFVTMGNFARGTGVIQLYEIQHGDLKLLREIEKAKPIKCGTFGATSLQQRYLATGDFGGNLHIWNLEAPEMPVYSVKGHKEIINAIDGIGGLGIGEGAPEIVTGSRDGTVKVWDPRQKDDPVANMEPVQGENKRDCWTVAFGNAYNQEERVVCAGYDNGDIKLFDLRNMALRWETNIKNGVCSLEFDRKDISMNKLVATSLEGKFHVFDMRTQHPTKGFASVSEKVNMREMSFYEEE

SEQ ID NO: 843456 - protein, 117 aa, Homo sapiens
NKYKSIWGFPPGLCSKIQGDLGSTKALVRTSVVVYHQSTLAATGTSSFLLSLWWLVCVSNPSLFLMCPPLLGSFHAICWHQRRFCCSHTTLGHEGPWIFASGLSWPHSTLASPLVPP

SEQ ID NO: 843457 - protein, 201 aa, Homo sapiens
AGVCWGTVQLEAPEAHSRESQGSDAMRKHLSWWWLATVCMLLFSHLSAVQTRGIKHRIKWNRKALPSTAQITEAQVAENRPGAFIKQGRKLDIDFGAEGNRYYEANYWQFPDGIHYNGCSEANVTKEAFVTGCINATQAANQGEFQKPDNKLHQQVLWRLVQELCSLKHCEFWLERGAGLRVTMHQPVLLCLLALIWLMVK

SEQ ID NO: 843458 - protein, 201 aa, Homo sapiens; identical to SEQ ID NO: 843457

SEQ ID NO: 843459 - protein, 91 aa, Homo sapiens
SPGGRSGVGRERHLKDTEKAVCRFAVCLLVTTSATADGASGGRETDGNAWVARAPCRPHSSCRHEHAHTHARKTHTLPFATRSQVKYTKSN

SEQ ID NO: 843460 - protein, 630 aa, Homo sapiens
RLPSWKQDFRGCVTACRRRAGTWTPPRPRGSGSRAMAGNCGARGALSAHTLLFDLPPALLGELCAVLDSCDGALGWRGLERLSSSWLDVRHIEKYVDQGKSGTRELLWSWAQKNKTIGDLLQVLQEMGHRRAIHLITNYGAVLSPSEKSYQEGGFPNILFKETANVTVDNVLIPEHNEKGVLLKSSISFQNIIEGTRNFHKDFLIGEGEIFEVYRVEIQNLTYAVKLFKQEKKMQCKKHWKRFLSELEVLLLFHHPNILELAAYFTETEKFCLIYPYMRNGTLFDRLQCVGDTAPLPWHIRIGILIGISKAIHYLHNVQPCSVICGSISSANILLDDQFQPKLTDFAMAHFRSHLEHQSCTINMTSSSSKHLWYMPEEYIRQGKLSIKTDVYSFGIVIMEVLTGCRVVLDDPKHIQLRDLLRELMEKRGLDSCLSFLDKKVPPCPRNFSAKLFCLAGRCAATRAKLRPSMDEVLNTLESTQASLYFAEDPPTSLKSFRCPSPLFLENVPSIPVEDDESQNNNLLPSDEGLRIDRMTQKTPFECSQSEVMFLSLDKKPESKRNEEACNMPSSSCEESWFPKYIVPSQDLRPYKVNIDPSSEAPGHSCRSRPVESSCSSKFSWDEYEQYKKE

SEQ ID NO: 843461 - protein, 128 aa, Homo sapiens
RLPSWKQDFRGCVTACRRRAGTWTPPRPRGSGSRAMAGNCGARGALSAHTLLFDLPPALLGELCAVLDSCDGALGWRGLVSKNKLCENGVLILQGFWHVVVCKYKDSKYGCVALFEKTPSETYLHMET

SEQ ID NO: 843462 - protein, 235 aa, Homo sapiens
RLPSWKQDFRGCVTACRRRAGTWTPPRPRGSGSRAMAGNCGARGALSAHTLLFDLPPALLGELCAVLDSCDGALGWRGLERLSSSWLDVRHIEKYVDQGKSGTRELLWSWAQKNKTIGDLLQVLQEMGHRRAIHLITNYGAVLSPSEKSYQEGGFPNILFKETANVTVDNVLIPEHNEKGVLLKSSISFQNIIEGTRNFHKDFLIGEGEIFEVYRVEIQNLTYAVKLFKQVWKEL

SEQ ID NO: 843463 - protein, 135 aa, Homo sapiens
YFRIVTMDSNFVPVNDKFSIGQDPNSNRIAQWLEVVPEQGIVDLSFQLAPEAMLGTYTVAVAEGKTFGTFSVEEYVLPKFKVEVVEPKELSTVQESFLVKICCRYTYGKPMLGAVQVSVCQKANTYWYREVEREQ

SEQ ID NO: 843464 - protein, 250 aa, Homo sapiens
MSISGTLSSYYVDSIISHESEDAPPAKFPSGQYASSRQPGHAEHLEFPSCSFQPKAPVFGASWAPLSPHASGSLPSVYHPYIQPQGVPPAESRYLRTWLEPAPRGEAAPGQGQAAVKAEPLLGAPGELLKQGTPEYSLETSAGREAVLSNQRPGYGDNKICEGSEDKERPDQTNPSANWLHARSSRKKRCPYTKYQTLELEKEFLFNMYLTRDRRHEVARLLNLSERQVKIWFQNRRMKMKKMNKEQGKE

SEQ ID NO: 843465 - protein, 250 aa, Homo sapiens; identical to SEQ ID NO: 843464

SEQ ID NO: 843466 - protein, 250 aa, Homo sapiens; identical to SEQ ID NO: 843464

SEQ ID NO: 843467 - protein, 250 aa, Homo sapiens; identical to SEQ ID NO: 843464

SEQ ID NO: 843468 - protein, 250 aa, Homo sapiens; identical to SEQ ID NO: 843464

SEQ ID NO: 843469 - protein, 250 aa, Homo sapiens; identical to SEQ ID NO: 843464

SEQ ID NO: 843470 - protein, 264 aa, Homo sapiens [sequence omitted]

SEQ ID NO: 843471 - protein, 366 aa, Homo sapiens
MAVGKNKRLTKGGKKGAKKKVVDPFSKKDWYDVKAPAMFNIRKIVWNRTASVNLAHPRKTKHVAILDESSKELVVLFIGGDHCHDYSSKDIGTGIGFWPLSGTDSYYTPLQYDLGYGFVSYGAETHIVGSCKLKRVRDRAYLRSSFNSRWEQNRVDGILEWSLLEKYSRPGNENSPFVNTTFDPVLGNRIQQGTCNTVTGDDEPLDLFRYLMSKMAVGGFQLNQRTPKSNPVINRDEATLRIIALQVPEAGGHGAYTCAVHVTIRLGHTSGAQRMRCKKPNDLKEVVNKLIPDSIGKDIEKACQSIYPLHDVFVRKVKMLKKPKFELGKLMELHGEGSSSGKATGDETGAKVERADGYEPPVQESV

SEQ ID NO: 843472 - protein, 101 aa, Homo sapiens
SWVFPASVSHIFLFCASSYLPCSVTSTASRNCRRDWAGFPNLSQRFGGAESRPRTTNSFLLACQLSTVVKEARSAKLKGFLGSTNKSAGIDYQCLLLSRDW

SEQ ID NO: 843473 - protein, 744 aa, Homo sapiens
GNWSNQSTAAREMLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEAGIFCLVNHVSFCYLIVLMRNRMETVEDTNGSETGFRAWNVQSRGRIFLVSKPVLQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 843474 - protein, 626 aa, Homo sapiens
GNWSNQSTAAREMLARRQRDPLQALRRRNQELKQQVDSLLSESQLKEALEPNKRQHIYQRVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 843475 - protein, 476 aa, Homo sapiens
EILFSNSTRLSFETKRISVFIQTDKALYKPKQEVKFRIVTLFSDFKPYKTSLNISLRINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 843476 - protein, 744 aa, Homo sapiens; identical to SEQ ID NO: 843473

SEQ ID NO: 843477 - protein, 661 aa, Homo sapiens
GNWSNQSTAAREMLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEAGIFCLVNHVSFCYLIVLMRNRMETVEDTNGSETGFRAWNVQSRGRIFLVSKPVLQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKVKYESPH

SEQ ID NO: 843478 - protein, 481 aa, Homo sapiens
GNWSNQSTAAREMLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEAGIFCLVNHVSFCYLIVLMRNRMETVEDTNGSETGFRAWNVQSRGRIFLVSKPVLQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVRLLRSKSIHTRIMEKHSLRFFSIQLLPNSQESIFYLVPKKNLNDSLKNSFFK

SEQ ID NO: 843479 - protein, 133 aa, Homo sapiens
GNWSNQSTAAREMLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEYASFLPFFFLF

SEQ ID NO: 843480 - protein, 779 aa, Homo sapiens
GNWSNQSTAAREMLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEAGIFCLVNHVSFCYLIVLMRNRMETVEDTNGSETGFRAWNVQSRGRIFLVSKPVLQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKLSKPVSPREGKKKWPELYHILKTMHCSCLPCYKIMRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 843481 - protein, 697 aa, Homo sapiens
GNWSNQSTAAREMLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEAGIFCLVNHVSFCYLIVLMRNRMETVEDTNGSETGFRAWNVQSRGRIFLVSKPVLQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKLSKPVSPREGKKKWPELYHILKTMHCSCLPCYKIMVITNPNLL

SEQ ID NO: 843482 - protein, 341 aa, Homo sapiens
GNWSNQSTAAREMLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEAGIFCLVNHVSFCYLIVLMRNRMETVEDTNGSETGFRAWNVQSRGRIFLVSKPVLQVTFLISFFFFLYKKNR

SEQ ID NO: 843483 - protein, 156 aa, Homo sapiens
GASDKGELVVLKLLFSPTAQVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLP

SEQ ID NO: 843484 - protein, 349 aa, Homo sapiens
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 843485 - protein, 349 aa, Homo sapiens; identical to SEQ ID NO: 843484

SEQ ID NO: 843486 - protein, 349 aa, Homo sapiens; identical to SEQ ID NO: 843484

SEQ ID NO: 843487 - protein, 349 aa, Homo sapiens; identical to SEQ ID NO: 843484

SEQ ID NO: 843488 - protein, 349 aa, Homo sapiens; identical to SEQ ID NO: 843484

SEQ ID NO: 843489 - protein, 349 aa, Homo sapiens; identical to SEQ ID NO: 843484

SEQ ID NO: 843490 - protein, 349 aa, Homo sapiens; identical to SEQ ID NO: 843484

SEQ ID NO: 843491 - protein, 321 aa, Homo sapiens
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 843492 - protein, 349 aa, Homo sapiens; identical to SEQ ID NO: 843484

SEQ ID NO: 843493 - protein, 155 aa, Homo sapiens
WPAGRASGDKRWRPPRHCEHRQSAPLGVGGVALASPASLKNPAGERGCGPAAALPHTPRREASLGAQHGGWALRPAANGAPGRLDRGCGGDGRPRGGRAAAGAEPGPAHDRLQLDAGDGGRVDAEIIQICIGRERTFSDIHVQYEYVAQAKQVTC

SEQ ID NO: 843494 - protein, 101 aa, Homo sapiens
TRHTAHAHIIALHSRLAHEHTHKDTAHTCTHSGTHAHTYTHTHIHTCSCVYTCPYTPHRCTYTHVFMHIRACPRAHPYRYIHTLIHVHVSTCVSTYMTMSP

SEQ ID NO: 843495 - protein, 134 aa, Homo sapiens
VLQLLPEATYKQPCHVATQHWSCHTHAQSYMSTHTCTRVPKHACTYMAVLIHVCTHTHASMHIHAHTHAHTYTHTHIHTCSCVYTCPYTPHRCTYTHVFMHIRACPRAHPYRYIHTLIHVHVSTCVSTYMTMSP

SEQ ID NO: 843496 - protein, 115 aa, Homo sapiens
VWPSEQGARELGDEDGSHFLFLNKNHMVGVCVYKRGSSVGASSPSTLWFQFPVLSRTRAQEAKAGRERVPTGPLGMSWLWTFLPCSPIRAPLQETGRMPLPTPQSLRQAEWIRLR

SEQ ID NO: 843497 - protein, 71 aa, Homo sapiens
GSEDYAEITLKDSQTIPGGGSSLNLFFPRSKPLSSDVLGMGSDWQKLISSQWEPTELSRVPRKKTGAISQS

SEQ ID NO: 843498 - protein, 115 aa, Homo sapiens; identical to SEQ ID NO: 843496

SEQ ID NO: 843499 - protein, 393 aa, Homo sapiens
MEALGPGGDRASPASSTSSLDLWHLSMRADSAYSSFSAASGGPEPRTQSPGTDLLPYLDWDYVRVVWGGPGPAPPDAALCTSPRPRPAVAARSGPQPTEVPGTPGPLNRQATPLLYALAAEAEAAAQAAEPPSPPASRAAYRQRLQGAQRRVLRETSFQRKELRMSLPARLRPTVPARPPATHPRSASLSHPGGEGEPARSRAPAPGTAGRGPLANQQRKWCFSEPGKLDRVGRGGGPARECLGEACSSSGLPGPEPLEFQHPALAKFEDHEVGWLPETQPQGSMNLDSGSLKLGDAFRPASRSRSASGEVLGSWGGSGGTIPIVQAVPQGAETPRPLFQTKLSRFLPQKEAAVMYPAELPQSSPADSEQRVSEKTEEHLRCKAAYFFFNKNC

SEQ ID NO: 843500 - protein, 627 aa, Homo sapiens
MEALGPGGDRASPASSTSSLDLWHLSMRADSAYSSFSAASGGPEPRTQSPGTDLLPYLDWDYVRVVWGGPGPAPPDAALCTSPRPRPAVAARSGPQPTEVPGTPGPLNRQATPLLYALAAEAEAAAQAAEPPSPPASRAAYRQRLQGAQRRVLRETSFQRKELRMSLPARLRPTVPARPPATHPRSASLSHPGGEGEPARSRAPAPGTAGRGPLANQQRKWCFSEPGKLDRVGRGGGPARECLGEACSSSGLPGPEPLEFQHPALAKFEDHEVGWLPETQPQGSMNLDSGSLKLGDAFRPASRSRSASGEVLGSWGGSGGTIPIVQAVPQGAETPRPLFQTKLSRFLPQKEAAVMYPAELPQSSPADSEQRVSETCIVPAWLPSLPDEVFLEEAPLVRMRSPPDPHASQGPPASVHASDQPYGTGLGQRTGQVTVPTEYPLHECPGTAGADDCWQGVNGSVGISRPTSHTPTGTANDNIPTIDPTGLTTNPPTAAESDLLKPVPADALGLSGNDTPGPSHNTALARGTGQPGSRPTWPSQCLEELVQELARLDPSLCDPLASQPSPEPPLGLLDGLIPLAEVRAAMRPACGEAGEEAASTFEPGSYQFTSPVWRSSERQGETCPPPC

SEQ ID NO: 843501 - protein, 107 aa, Homo sapiens
MPSGPPVGVGALQAKSWVPGEDQEGPYPLSRYGSQEMQAGEGSIWETKLEPHFSRLFTLPGCSPRSRNPQTIVSDQTFQVRDTDHSGPSWGEAACIAFAQKMKGLPT

SEQ ID NO: 843502 - protein, 490 aa, Homo sapiens
MEALGPGGDRASPASSTSSLDLWHLSMRADSAYSSFSAASGGPEPRTQSPGTDLLPYLDWDYVRVVWGGPGPAPPDAALCTSPRPRPAVAARSGPQPTEVPGTPGPLNRQATPLLYALAAEAEAAAQAAEPPSPPASRAAYRQRLQGAQRRVLRETSFQRKELRMSLPARLRPTVPARPPATHPRSASLSHPGGEGEPARSRAPAPGTAGRGPLANQQRKWCFSEPGKLDRVGRGGGPARECLGEACSSSGLPGPEPLEFQHPALAKFEDHEVGWLPETQPQGSMNLDSGSLKLGDAFRPASRSRSASGEVLGSWGGSGGTIPIVQAVPQGAETPRPLFQTKLSRFLPQKEAAVMYPAELPQSSPADSEQRVSETCIVPAWLPSLPDEVFLEEAPLVRMRSPPDPHASQGPPASVHASDQPYGTGLGQRTGQVTVPTEYPLHECPGTAGADDCWQGVNGSLQRVTSSNLSQLMPWDFQAMILQVPLTILP

SEQ ID NO: 843503 - protein, 644 aa, Homo sapiens
MEIPAPEPEKTALSSQDPALSLKENLEDISGWGLPEARSKESVSFKDVAVDFTQEEWGQLDSPQRALYRDVMLENYQNLLALGPPLHKPDVISHLERGEEPWSMQREVPRGPCPEWELKAVPSQQQGICKEEPAQEPIMERPLGGAQAWGRQAGALQRSQAAPWAPAPAMVWDVPVEEFPLRCPLFAQQRVPEGGPLLDTRKNVQATEGRTKAPARLCAGENASTPSEPEKFPQVRRQRGAGAGEGEFVCGECGKAFRQSSSLTLHRRWHSREKAYKCDECGKAFTWSTNLLEHRRIHTGEKPFFCGECGKAFSCHSSLNVHQRIHTGERPYKCSACEKAFSCSSLLSMHLRVHTGEKPYRCGECGKAFNQRTHLTRHHRIHTGEKPYQCGSCGKAFTCHSSLTVHEKIHSGDKPFKCSDCEKAFNSRSRLTLHQRTHTGEKPFKCADCGKGFSCHAYLLVHRRIHSGEKPFKCNECGKAFSSHAYLIVHRRIHTGEKPFDCSQCWKAFSCHSSLIVHQRIHTGEKPYKCSECGRAFSQNHCLIKHQKIHSGEKSFKCEKCGEMFNWSSHLTEHQRLHSEGKPLAIQFNKHLLSTYYVPGSLLGAGDAGLRDVDPIDALDVAKLLCVVPPRAGRNFSLGSKPRN

SEQ ID NO: 843504 - protein, 121 aa, Homo sapiens
MEIPAPEPEKTGIGEFQGCGCGLHPGGVGSTRLPSEGLVPGCDVGELPEPSCPRTSTAQARCDLSSGTRRGAMEHAEGSPQRALSRDRISLCHPGWSVVPQSQLTAASNLWAQVILPQPPE

SEQ ID NO: 843505 - protein, 573 aa, Homo sapiens
MLENYQNLLALGPPLHKPDVISHLERGEEPWSMQREVPRGPCPEWELKAVPSQQQGICKEEPAQEPIMERPLGGAQAWGRQAGALQRSQAAPWAPAPAMVWDVPVEEFPLRCPLFAQQRVPEGGPLLDTRKNVQATEGRTKAPARLCAGENASTPSEPEKFPQVRRQRGAGAGEGEFVCGECGKAFRQSSSLTLHRRWHSREKAYKCDECGKAFTWSTNLLEHRRIHTGEKPFFCGECGKAFSCHSSLNVHQRIHTGERPYKCSACEKAFSCSSLLSMHLRVHTGEKPYRCGECGKAFNQRTHLTRHHRIHTGEKPYQCGSCGKAFTCHSSLTVHEKIHSGDKPFKCSDCEKAFNSRSRLTLHQRTHTGEKPFKCADCGKGFSCHAYLLVHRRIHSGEKPFKCNECGKAFSSHAYLIVHRRIHTGEKPFDCSQCWKAFSCHSSLIVHQRIHTGEKPYKCSECGRAFSQNHCLIKHQKIHSGEKSFKCEKCGEMFNWSSHLTEHQRLHSEGKPLAIQFNKHLLSTYYVPGSLLGAGDAGLRDVDPIDALDVAKLLCVVPPRAGRNFSLGSKPRN

SEQ ID NO: 843506 - protein, 573 aa, Homo sapiens; identical to SEQ ID NO: 843505

SEQ ID NO: 843507 - protein, 91 aa, Homo sapiens
LDGRCLFGAVGYTCRKPVTSLPIHEGWLHTLQNICAKELDSLQRTMMPGNHRQATLLTNKATGPARNNSVISTGLEMTQQFHSCTSTRELP

SEQ ID NO: 843508 - protein, 470 aa, Homo sapiens
KSDEKIVIHHKPLRSTWSQLSAVKRKGLSQTVSQEERKRQEAIFEVISSEHSYLLSLEILIRMFKNSKELSDTMTKTERHHLFSNITDVCEASKKFFIELEARHQNNIFIDDISDIVEKHTASTFDPYVKYCTNEVYQQRTLQKLLATNPSFKEVLSRIESHEDCRNLPMISFLILPMQRVTRLPLLMDTICQKTPKDSPKYEVCKRALKEVSKLVRLCNEGARKMERTEMMYTINSQLEFKIKPFPLVSSSRWLVKRGELTAYVEDTVLFSRRTSKQQVYFFLFNDVLIITKKKSEESYNVNDYSLRDQLLVESCDNEELNSSPGKNSSTMLYSRQSSASHLFTLTVLSNHANEKVEMLLGAETQSERARWITALGHSSGKPPADRTSLTQVEIVRSFTAKQPDELSLQVADVVLIYQRVSDGWYEGERLRDGERGWFPMECAKEITCQATIDKNVERMGRLLGLETNV

SEQ ID NO: 843509 - protein, 470 aa, Homo sapiens; identical to SEQ ID NO: 843508

SEQ ID NO: 843510 - protein, 390 aa, Homo sapiens
KSDEKIVIHHKPLRSTWSQLSAVKRKGLSQTVSQEERKRQEAIFEVISSEHSYLLSLEILIRMFKNSKELSDTMTKTERHHLFSNITDVCEASKKFFIELEARHQNNIFIDDISDIVEKHTASTFDPYVKYCTNEVYQQRTLQKLLATNPSFKEVLSRIESHEDCRNLPMISFLILPMQRVTRLPLLMDTICQKTPKDSPKYEVCKRALKEVSKLVRLCNEGARKMERTEMMYTINSQLEFKIKPFPLVSSSRWLVKRGELTAYVEDTVLFSRRTSKQQVYFFLFNDVLIITKKKSEESYNVNDYSLRDQLLVESCDNEELNSSPGKNSSTMLYSRQSSASHLFTLTVLSNHANEKVEMLLGAETQSERARWITALGHSSGKPPADRTCG

SEQ ID NO: 843511 - protein, 390 aa, Homo sapiens; identical to SEQ ID NO: 843510

SEQ ID NO: 843512 - protein, 470 aa, Homo sapiens; identical to SEQ ID NO: 843508

SEQ ID NO: 843513 - protein, 470 aa, Homo sapiens; identical to SEQ ID NO: 843508

SEQ ID NO: 843514 - protein, 119 aa, Homo sapiens
MQLSGHKPRRHPDSSVHSSHSSPGSKFFPLALANTHILNLTASPTITSLLGSLRSLLTPLCSCTVTLRQSLCNENGLIADHSHSLAPTPHGFPFQRTNSPLLTRSYRLPFMWPLPNSAT

SEQ ID NO: 843515 - protein, 229 aa, Homo sapiens
MAIHYSRQTALESTSYIQLPEAELRMERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGENHRSDQGTLTRRQ

SEQ ID NO: 843516 - protein, 215 aa, Homo sapiens
MYFRLCGPHEGRFFFLTSSSASSSSSLSSSFFLQLRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKASLELAIKQWGSQ

SEQ ID NO: 843517 - protein, 117 aa, Homo sapiens
MAIHYSRQTALESTSYIQLPEAELRMERMLPLLALGLLAAGFCPAVLCHPNSPLDEENLTQENQDRGTHVDLGLASANVDFAFSLYKQWSIRLCLMYLRRAQKHLLPQQSKSPSFLH

SEQ ID NO: 843518 - protein, 131 aa, Homo sapiens
RRSRGSRRSPIRDEELSCTVVELKYTGNASALFILPDQDKMEEVEAMLLPETLKRWRDSLEFREIGELYLPKFSISRDYNLNDILLQLGIEEAFTSKADLSGITGARNLAVSQSIRLCLIYFEETRQFGRL

SEQ ID NO: 843519 - protein, 229 aa, Homo sapiens; identical to SEQ ID NO: 843515

SEQ ID NO: 843520 - protein, 229 aa, Homo sapiens; identical to SEQ ID NO: 843515

SEQ ID NO: 843521 - protein, 229 aa, Homo sapiens; identical to SEQ ID NO: 843515

SEQ ID NO: 843522 - protein, 228 aa, Homo sapiens
GRVGRPTRPWNPPGYIQLPEAELRMERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGENHRSDQGTLTRRQ

SEQ ID NO: 843523 - protein, 229 aa, Homo sapiens; identical to SEQ ID NO: 843515

SEQ ID NO: 843524 - protein, 229 aa, Homo sapiens; identical to SEQ ID NO: 843515

SEQ ID NO: 843525 - protein, 229 aa, Homo sapiens; identical to SEQ ID NO: 843515

SEQ ID NO: 843526 - protein, 229 aa, Homo sapiens; identical to SEQ ID NO: 843515

SEQ ID NO: 843527 - protein, 229 aa, Homo sapiens; identical to SEQ ID NO: 843515

SEQ ID NO: 843528 - protein, 229 aa, Homo sapiens; identical to SEQ ID NO: 843515

SEQ ID NO: 843529 - protein, 183 aa, Homo sapiens
MAIHYSRQTALESTSYIQLPEAELRMERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSTKKLINDYVKNGTRGENHRSDQGTLTRRQ

SEQ ID NO: 843530 - protein, 241 aa, Homo sapiens
MAIHYSRQTALESTSYIQLPEAELRMERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGEAKWEMPFEPPRYSSVKVLLEARKSG

SEQ ID NO: 843531 - protein, 229 aa, Homo sapiens; identical to SEQ ID NO: 843515

SEQ ID NO: 843532 - protein, 190 aa, Homo sapiens
RAAGIGTRQVRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKASLELAIKQWGSQ

SEQ ID NO: 843533 - protein, 191 aa, Homo sapiens
RRSRGSRRSPIRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKASLELAIKQWGSQ

SEQ ID NO: 843534 - protein, 229 aa, Homo sapiens; identical to SEQ ID NO: 843515

SEQ ID NO: 843535 - protein, 287 aa, Homo sapiens
MAIHYSRQTALESTSYIQLPEAELRMERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGEPEAVERLSGVQVILPGPQRPHISPRQGLTNVQGQGHGGGRTHTGTGGIYTYFALCCLHGFGLDFSFSSLRQ

SEQ ID NO: 843536 - protein, 193 aa, Homo sapiens
PGCRNWHEARVGNGAHDEFASPDYTLLPGRVRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVRPFLMIIVPTDTQNIFFMSKVTNPKASLELAIKQWGSQ

SEQ ID NO: 843537 - protein, 151 aa, Homo sapiens
PTKLFIAVRRPRTLQTEESMGPCACESYTGNRCHLPRISRQGHTCHGHSVHRGQAVPRHPEHLLHEQSHQSQSKPRACHQAVGLSVRNLECKLDAWVSGHSLAPVHRVAMACVALSAYPWKVTAIPCVALTCTGAHGLFSLEGPGPPDSNK

SEQ ID NO: 843538 - protein, 103 aa, Homo sapiens
MAIHYSRQTALESTSYIQLPEAELRMERMLPLLALGLLAAGFCPAVLCHPNSPLDEENLTQENQDRGTHVDLGLASANVDFAFSLYKQLVLKAPDKNVIFSLS

SEQ ID NO: 843539 - protein, 152 aa, Homo sapiens
MEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPAAIAASAWASEDLMS

SEQ ID NO: 843540 - protein, 204 aa, Homo sapiens
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGENHRSDQGTLTRRQ

SEQ ID NO: 843541 - protein, 74 aa, Homo sapiens
VGWWGRQSHNCVSGERAWWHPNSPLDEENLTQENQDRGTHVDLGLASANVDFAFSLYKQLVLKAPDKNVIFSLS

SEQ ID NO: 843542 - protein, 229 aa, Homo sapiens; identical to SEQ ID NO: 843515

SEQ ID NO: 843543 - protein, 229 aa, Homo sapiens; identical to SEQ ID NO: 843515

SEQ ID NO: 843544 - protein, 204 aa, Homo sapiens; identical to SEQ ID NO: 843540

SEQ ID NO: 843545 - protein, 229 aa, Homo sapiens; identical to SEQ ID NO: 843515

SEQ ID NO: 843546 - protein, 197 aa, Homo sapiens
IHGNPLLQTDGFGIHQHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGENHRSDQGTLTRRQ

SEQ ID NO: 843547 - protein, 229 aa, Homo sapiens; identical to SEQ ID NO: 843515

SEQ ID NO: 843548 - protein, 151 aa, Homo sapiens
MEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKASLELAIKQWGSQ

SEQ ID NO: 843549 - protein, 151 aa, Homo sapiens; identical to SEQ ID NO: 843548

SEQ ID NO: 843550 - protein, 229 aa, Homo sapiens; identical to SEQ ID NO: 843515

SEQ ID NO: 843551 - protein, 232 aa, Homo sapiens
SNCLLHLQPNGRCPLNPQDTHQSRFYLRQEKVGNGAHDEFASPDYTLLPGRVRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKASLELAIKQWGSQ

SEQ ID NO: 843552 - protein, 223 aa, Homo sapiens
PTKLFIAVRRPRTLQTEESMGPCACESYTGNRCHLPRISRQGLRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKASLELAIKQWGSQ

SEQ ID NO: 843553 - protein, 223 aa, Homo sapiens
MAIHYSRQTALESTSYIQLPEAELRMERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQVVHKAVLDVFEEGTEASAATAVKITLLSALVETRTIVRFNRPFLMIIVPTDTQNIFFMSKVTNPKASLELAIKQWGSQ

SEQ ID NO: 843554 - protein, 111 aa, Homo sapiens
KLELAISSGALSKELGMQAGCLGLWARIPEQSPVVHKAVLDVFEEGTEASAATAVKITLLSALVETRTIVRFNRPFLMIIVPTDTQNIFFMSKVTNPKASLELAIKQWGSQ

SEQ ID NO: 843555 - protein, 168 aa, Homo sapiens
MAIHYSRQTALESTSYIQLPEAELRMERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQGTWPSFAARWSSTTWTEPTQHNL

SEQ ID NO: 843556 - protein, 121 aa, Homo sapiens
MAIHYSRQTALESTSYIQLPEAELRMERMLPLLALGLLAAGFCPAVLCHPNSPLDEENLTQENQDRGSRRQKAERRKQQLAEEEARRPRGEDGKPVRKGPGKQEEVCVIDALLADIQVSGD

SEQ ID NO: 843557 - protein, 31 aa, Homo sapiens
MPDAGDAGTSCGTACYCLELVSMDLELHRPL

SEQ ID NO: 843558 - protein, 105 aa, Homo sapiens
SGNEGLGGTVRPGLGRRTPGRKNRWEWRSSWEWWGGWGPSCAQIPMRNWSQPPVSPCPSLCRQLWVLPPNMSKPPPSSPVPRPGSCLLPTSGPDTFHPSLLGRPA

SEQ ID NO: 843559 - protein, 136 aa, Homo sapiens
NKTKRIHTASPLHFTQKRNVLGHFLFSTHPQGTKIGSQSPPSSSFPSPLTHRGISGPTDPALPSRGTGPTHPVSLLVTHSTQGTMEGFCALDGNKPHLTFPHLRSHQGPLCPVLTLNVCPGSPLSSLLEIGMAPDR

SEQ ID NO: 843560 - protein, 43 aa, Homo sapiens
MNKLYIGNLSENAAPSDLESIFKDAKIPVSGPFLVKTGYAFVD

SEQ ID NO: 843561 - protein, 40 aa, Homo sapiens
MESFMESLNRLKEIHEKEVLGLQNKLLELNSERCRESGQA

SEQ ID NO: 843562 - protein, 1338 aa, Homo sapiens
KLPTPPPQGPGFAPGDRWCWCSQGGGLAFFGSGCHGGAQARLAGLVFSGLSPAWQRRQAPLGLPVPLCHGDAQPLLPATACHGGTRSSPCRGQPVLLPWLFLVQAAMAALRAYRKKNFGSEAFLCPEVSAALGKMAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 843563 - protein, 596 aa, Homo sapiens
KLPTPPPQGPGFAPGDRWCWCSQGGGLAFFGSGCHGGAQARLAGLVFSGLSPAWQRRQAPLGLPVPLCHGDAQPLLPATACHGGTRSSPCRGQPVLLPWLFLVQAAMAALRAYRKENFGSEAFLCPEVSAALGKMAAAAAVGNAVPCGARPCGVRPDGQPKPGPQPRALLAAGPALIANGDELVVPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 843564 - protein, 110 aa, Homo sapiens
RTSVGACFPVLRRASGEPCHMVLPSLRARQALLRPHVLLGSLFEAACHAQVGGVRVETPYPRGLALGTGWGLVSCRAEMVVPDFSELFKERATAPFFVFQVKQQLWPISP

SEQ ID NO: 843565 - protein, 1361 aa, Homo sapiens
KLPTPPPQGPGFAPGDRWCWCSQGGGLAFFGSGCHGGAQARLAGLVFSGLSPAWQRRQAPLGLPVPLCHGDAQPLLPATACHGGTRSSPCRGQPVLLPWLFLVQAAMAALRAYRKKNFGSEAFLCPEVSAALGKMAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRVSPKGEVLHPILARADSLLSTLQDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 843566 - protein, 1338 aa, Homo sapiens; identical to SEQ ID NO: 843562

SEQ ID NO: 843567 - protein, 297 aa, Homo sapiens
MPMQLCLGLSSTPDVMHATPSHDVDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 843568 - protein, 1338 aa, Homo sapiens; identical to SEQ ID NO: 843562

SEQ ID NO: 843569 - protein, 1278 aa, Homo sapiens
KLPTPPPQGPGFAPGDRWCWCSQGGGLAFFGSGCHGGAQARLAGLVFSGLSPAWQRRQAPLGLPVPLCHGDAQPLLPATACHGGTRSSPCRGQPVLLPWLFLVQAAMAALRAYRKKNFGSEAFLCPEVSAALGKMAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKVRPGPAQTFTVCPPSPTPKLKVPS

SEQ ID NO: 843570 - protein, 968 aa, Homo sapiens
KLPTPPPQGPGFAPGDRWCWCSQGGGLAFFGSGCHGGAQARLAGLVFSGLSPAWQRRQAPLGLPVPLCHGDAQPLLPATACHGGTRSSPCRGQPVLLPWLFLVQAAMAALRAYRKKNFGSEAFLCPEVSAALGKMAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQVRAQAPPAFTMCLARQLLPESPPVSHSARLNGCDFVLLAPPPASTFGDSKWHSVCPLLWGPTQSWLTQSTRRAYLPQSWCVPSSTLLPWSWAGLGGILSPLTHPSSTKPTLRLHHRHICRLASSWALVLSACTL

SEQ ID NO: 843571 - protein, 1086 aa, Homo sapiens
MEKWEELNSHQPGEEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 843572 - protein, 117 aa, Homo sapiens
LPGGSWNCRLRRAKPQCFLCLCQEYDPSKATFVKVVPTPNNGSTELVALHRNEGEDGLEVLSFEFQKIKYSYDALEKKQFLPVAFPVGNAFSYYQSNRGFQEDSEIRAAEKKFGSNK

SEQ ID NO: 843573 - protein, 572 aa, Homo sapiens
MSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 843574 - protein, 1366 aa, Homo sapiens
KLPTPPPQGPGFAPGDRWCWCSQGGGLAFFGSGCHGGAQARLAGLVFSGLSPAWQRRQAPLGLPVPLCHGDAQPLLPATACHGGTRSSPCRGQPVLLPWLFLVQAAMAALRAYRKKNFGSEAFLCPEVSAALGKMAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKVRPGPCPNIHCLPTQPHPMKPSVPHPQQGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 843575 - protein, 1331 aa, Homo sapiens
KLPTPPPQGPGFAPGDRWCWCSQGGGLAFFGSGCHGGAQARLAGLVFSGLSPAWQRRQAPLGLPVPLCHGDAQPLLPATACHGGTRSSPCRGQPVLLPWLFLVQAAMAALRAYRKKNFGSEAFLCPEVSAALGKMAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEVLLLDFCLALLADRVLQFFLGTPKLKVPS

SEQ ID NO: 843576 - protein, 187 aa, Homo sapiens
GWPQVSQILTPPPALLLQPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 843577 - protein, 909 aa, Homo sapiens
KLPTPPPQGPGFAPGDRWCWCSQGGGLAFFGSGCHGGAQARLAGLVFSGLSPAWQRRQAPLGLPVPLCHGDAQPLLPATACHGGTRSSPCRGQPVLLPWLFLVQAAMAALRAYRKKNFGSEAFLCPEVSAALGKMAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVADRVLQFFLGTPKLKVPS

SEQ ID NO: 843578 - protein, 537 aa, Homo sapiens
AEVTTEAGRRRKMAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSRDTTMYAVSADSKGLDTVVALLADVVLQPRLTDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 843579 - protein, 205 aa, Homo sapiens [sequence omitted]

SEQ ID NO: 843580 - protein, 712 aa, Homo sapiens
MAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSRDTTMYAVSADSKGLDTVVALLADVVLQPRLTDEEVEMTRMAVQFELEDLNLRPDPEPLLTEMIHEVKCQTRECPRISNSGPRDTRGGGEGASVMLSLQVYGYIQNIFLFFEMRFLHIAYAGLALLGSAQVILLPLPPKYAGITGVSHRTQLRTFLISESAVYTMFVFSSFYSNWSLLLNTINLRLFVNLYSGEADFTLYKYARSCYCQSASKISACVGFSQGWLQMGAGAACWRKPGHAVFSHLCLWLFPIEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 843581 - protein, 376 aa, Homo sapiens
MYAVSADSKGLDTVVALLADVVLQPRLTDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 843582 - protein, 394 aa, Homo sapiens
MKRNTLVELLTFWKNWHFRLLLDLTAKMKFCLRWKSMGVSVTARHQDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 843583 - protein, 275 aa, Homo sapiens
MVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 843584 - protein, 497 aa, Homo sapiens
MAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSRDTTMYAVSADSKGLDTVVALLADVVLQPRLTDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLILRSVLYACVCAVLVCVLCSCVCCVSSRV

SEQ ID NO: 843585 - protein, 269 aa, Homo sapiens
AEVTTEAGRRRKMAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSRDTTMYAVSADSKGLDTVVALLADVVLQPRLTDEEVEMTRMAVQFELEDLNLRPDPEPLLTEMIHEVKCQTRECPRISNSGPRDTRGGGEGASVMLSLQVMDIYRTFFCFLR

SEQ ID NO: 843586 - protein, 161 aa, Homo sapiens
MAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSRYTSFCVQTDFGSLGT

SEQ ID NO: 843587 - protein, 171 aa, Homo sapiens
AEVTTEAGRRRKMAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSVSTQFCNFLDYTFEGCLRFFLSIMVILINYQVAKLMLIKDF

SEQ ID NO: 843588 - protein, 537 aa, Homo sapiens; identical to SEQ ID NO: 843578

SEQ ID NO: 843589 - protein, 537 aa, Homo sapiens; identical to SEQ ID NO: 843578

SEQ ID NO: 843590 - protein, 275 aa, Homo sapiens; identical to SEQ ID NO: 843583

SEQ ID NO: 843591 - protein, 563 aa, Homo sapiens
MAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSRDTTMYAVSADSKGLDTVVALLADVVLQPRLTDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIREYRRGSEGLPQASARLRGGRLALPQAVVGLWYVHHTQNLGPSPVVLSRGGQGQGRGVADLVSLPGPTMHLLPPWQVTPPSAPLGGAVTTAQSC

SEQ ID NO: 843592 - protein, 139 aa, Homo sapiens
MFSFGHRDGVLPLLEWGVEGGTGRVCAHLTGPWPQVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 843593 - protein, 269 aa, Homo sapiens; identical to SEQ ID NO: 843585

SEQ ID NO: 843594 - protein, 123 aa, Homo sapiens
AEVTTEAGRRRKMAAVVLAATRLLRGSGSWGCSRLRFGPPAYRRFSSGGAYPNIPLSSPLPGVPKPVFATVDGQEKFETKVTTLDNGLRVASQNKFGQFCTVGSKYCCVVVGGPAVLTCTCFS

SEQ ID NO: 843595 - protein, 96 aa, Homo sapiens
PLITTYYTPIGSVKLIRKEIEFHDYISSYPPSTLPVPFKRFTKTLLAVLYNLQMLNHLVPHHSCKAPFYSQIKCPGFRQQLYAIIYLMSISSCAWN

SEQ ID NO: 843596 - protein, 832 aa, Homo sapiens
NKRILGRVNLSLNDSHYGQQDKGTSLRETQEMTEGSRLEPNSEFGKESTFGISSKESMSCHDESSVSLRSLKSIEIMPSQENSETNVNSEETDLKNLCKPKDGEMLCENVKDCTVLPEMKEIVSRDWSNSSDRDSVCTCVEKNACKACHPHENSSDRHLPLTVKTDIKVKGEETEEHQRGRLGYLTVGEQSEELVTRETGDGDPVSNISQTHFKCRGILNHAEKQQSPEVLDYMLQKEEKYIRQQKAHTISQQCISSSLLLDDAQNQNQPKADKDESTMINEITLAKLAKDSIVAQTQKLEDQKEERLHHPLRKDTESCTSPCLLGAPRKAQDPSSAGCDQIHGAFAKKGVLPLKKQPHRTCKKVSYQEQIIVGRKIGKIRSSAFLKSSSNPIPTKAHRLLSLCTLSAPTRLEPETAPTKSLVSHIPKQMSTPCHPLRSLNFRKTTKESALLNKLSILASKLAPAMKTQKLRYRRCSSELLPMAKSYKRLRYKRLLDGFSSSTEQLNPYLAASGWDKRPNSKPMALYSLESIKMTFIDLSNKMPSLLFGSEIFPVSFHVKSSSSDCTTESSRTFPEHCAPARLALGEALQCPSQPPKWTFSFFLSHGCPGMATFREDTGVHSQTHTQAPPQPPAPLQDYGGTAIVQTRADCSVLGLHTLLALCSPGCYRIWTKKRSFSSHMPTMQRLFMTQFTQGLKGLRSPASIADKVFCSLPYSVGRVLSIWSQHGPSVCSFEISSLHSPHCKRQPSLGTTSSHTMLPYVPLPGMEATYNTSGSQTRLEPPFPALVPKSCLVAESAVSKLLLSASEFQVRGLDELDGVKAACPCPQSSPP

SEQ ID NO: 843597 - protein, 1146 aa, Homo sapiens
AAAAGLGSSESSSDFLFCTYIILYILYMMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 843598 - protein, 786 aa, Homo sapiens
MAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 843599 - protein, 552 aa, Homo sapiens
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKRTAAAELSSSPLSQLSSSLSGHQNSMTSAHATRSTSTPHTHASVESTASSAAFSAAATSAPSAPSSGVVLPGSMSTVSSLCLGGTTVSVPSSSTRATALVTSQSTPKLTSGGASPAAQPVPRGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 843600 - protein, 1174 aa, Homo sapiens
AAAAGLGSSESSSDFLFCTYIILYILYMMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGEGYFPDRDNGVRQACLAHTCLLYPATLGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 843601 - protein, 1146 aa, Homo sapiens; identical to SEQ ID NO: 843597

SEQ ID NO: 843602 - protein, 1139 aa, Homo sapiens
AAAAGLGSSESSSDFLFCTYIILYILYMMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGRVSAAAVLSQSQLQLLALSSGN

SEQ ID NO: 843603 - protein, 1061 aa, Homo sapiens
AAAAGLGSSESSSDFLFCTYIILYILYMMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVSISEGVTVSPGLGLLAGGNLGPIFQQGGRVVIPLRLTWSSETVQAGDKVTFPLLCLDPACVALMKTQVPCGCGYVTCCLRLWQGYLTSLSLPLPTLIPHLL

SEQ ID NO: 843604 - protein, 828 aa, Homo sapiens
AAAAGLGSSESSSDFLFCTYIILYILYMMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGVSLSSSMNTANSLCLGGTPASASSSSSRAAPLVTSGICSRGLSCPP

SEQ ID NO: 843605 - protein, 496 aa, Homo sapiens
AAAAGLGSSESSSDFLFCTYIILYILYMMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSMGSTVGCQQHKQFCNTATHSRHTRTAAPSAAARKSCSKAHPQSVAREKTTTWQQAQQAGQSVVQQQFYTVHRQMAHCIAHPSWTKPFSIRGQSAAPGVAGICDVAKGSRGTDTVLNRKAMGVPFKSQQTYSRLPSTLHDCVLGPNTLRKILENADIRTWQHECTSDTETWAHQHNNHNDKLTDTCPEHTRAFHIIGTISQTRAPFSRKATFPVAPTTPAHHNQTQQLGNIDQNPHPYEKIDKRAEYPTLPPPHYLDVRHAHTQLTTLNCNNNVNSTNKATTESSQYDYAPLGPTPTPQRHMRHHTSRHDTQRDNTKSTSAQQDPIQSNTACHRKYNKRTRHSQTPQAPTTRTVTTHNTSTNKQPIPQTLRQ

SEQ ID NO: 843606 - protein, 141 aa, Homo sapiens
CLQKPVWPFSGWRKGSGWSQCSFLGDVTKFGRGDSASPAPATTPAQPQQSQSQTHHTAQQPFVNPALPPGYSYTGLPYYTGMPSAFQYGPTMFVSISEGVTVSPGLGLLAGGNLGPIFQQGGRVVIPLRLTWSSETVQAGD

SEQ ID NO: 843607 - protein, 1146 aa, Homo sapiens; identical to SEQ ID NO: 843597

SEQ ID NO: 843608 - protein, 1105 aa, Homo sapiens
ARDARSRDGLGSLCRRRRFVRGTLADFLFCTYIILYILYMMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 843609 - protein, 852 aa, Homo sapiens
MDSKGLGRILWKSGQQKTGLKIIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 843610 - protein, 1124 aa, Homo sapiens
AAAAGLGSSESSSDFLFCTYIILYILYMMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSMPVWRAPLPTSPQPPSPRQQTSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 843611 - protein, 358 aa, Homo sapiens
MNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 843612 - protein, 405 aa, Homo sapiens
QIHVSWLFFCQHASVESASSHQSSATFSTAATSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 843613 - protein, 1146 aa, Homo sapiens; identical to SEQ ID NO: 843597

SEQ ID NO: 843614 - protein, 1065 aa, Homo sapiens
AAAAGLGSSESSSDFLFCTYIILYILYMMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGGYMF

SEQ ID NO: 843615 - protein, 270 aa, Homo sapiens
AAAAGLGSSESSSDFLFCTYIILYILYMMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTDLDCRGRRPEGSHPRIS

SEQ ID NO: 843616 - protein, 137 aa, Homo sapiens
GTHRGTVGLAAAHHPRGRPHGEWLLFWLPGVASLSLQASACPMGAFPFLGQRRMLPRCGQSSRVQRNPDQSLGLGPKPCSLFHSQYELGQSFSPPVCQFPHLYKRHLDWNRAAYTLNESPRGLVEEQAQIQWVWAGA

SEQ ID NO: 843617 - protein, 677 aa, Homo sapiens
VLGLAATAKSNTSMSLQRIVRVSLEHPTSAVCVAGVETLVDIYGSVPEGTEMFEVYGTPGVDIYISPNMERGRERADTRRWRFDATLEIIVVMNSPSNDLNDSHVQISYHSSHEPLPLAYAVLYLTCVDISLDCDLNCEGRQDRNFVDKRQWVWGPSGYGGILLVNCDRDDPSCDVQDNCDQHVHCLQDLEDMSVMVLRTQGPAALFDDHKLVLHTSSYDAKRAQVFHICGPEDVCEAYRHVLGQDKVSYEVPRLHGDEERFFVEGLSFPDAGFTGLISFHVTLLDDSNEDFSASPIFTDTVVFRVAPWIMTPSTLPPLEVYVCRVRNNTCFVDAVAELARKAGCKLTICPQAENRNDRWIQDEMELGYVQAPHKTLPVVFDSPRNGELQDFPYKRILGPDFGYVTREPRDRSVSGLDSFGNLEVSPPVVANGKEYPLGRILIGGNLPGSSGRRVTQVVRDFLHAQKVQPPVELFVDWLAVGHVDEFLSFVPAPDGKGFRMLLASPGACFKLFQEKQKCGHGRALLFQGVVDDEQVKTISINQVLSNKDLINYNKFVQSCIDWNREVLKRELGLAECDIIDIPQLFKTERKKATAFFPDLVNMLVLGKHLGIPKPFGPIINGCCCLEEKVRSLLEPLGLHCTFIDDFTPYHMLHGEVHCGTNVCRKPFSFKWWNMVP

SEQ ID NO: 843618 - protein, 104 aa, Homo sapiens
MPEAHMQPAKLQTSLPTTDHGSKKPVSCYLPPLSNAHPMCIEVQNAQNCSSAAATLEPSIISDTCFYKPITKDQLSSRSELNTVRLKCLNSLRGWKILNQLSLT

SEQ ID NO: 843619 - protein, 104 aa, Homo sapiens; identical to SEQ ID NO: 843618

SEQ ID NO: 843620 - protein, 107 aa, Homo sapiens
PGLSSAHPRSSQKLPRLVSTGIGMEGSHGWLSPSRSRKRKLLKRRWGLGEDINQHGQDEDGWPLGTHLFGMNDVGKREWKWGTVAGTQKSSGPDEAKSQGSASNYSS

SEQ ID NO: 843621 - protein, 148 aa, Homo sapiens
MRYTPSLPSLQTSEWTSSLSVRAKCTQFCSVTTSTTGQCEVFELVLTENCQLPKDLGALLPTPGVRSCAWPPCLGYMQWSSRSLPHPCGLWDPLFQPAQGTSGCLRTQPSVKIRQVPSVCSWSTKKNFNFENGICIPKCSLRCLSSTK

SEQ ID NO: 843622 - protein, 148 aa, Homo sapiens; identical to SEQ ID NO: 843621

SEQ ID NO: 843623 - protein, 148 aa, Homo sapiens; identical to SEQ ID NO: 843621

SEQ ID NO: 843624 - protein, 148 aa, Homo sapiens; identical to SEQ ID NO: 843621

SEQ ID NO: 843625 - protein, 148 aa, Homo sapiens; identical to SEQ ID NO: 843621

SEQ ID NO: 843626 - protein, 213 aa, Homo sapiens
AAYTLSDDSWWADLNYFLSSLPFLAAVDSGVMGISSDQVRLLPPPKNERKFCYDVSSCRSSFPETMNKWNTFYQYLQSPFSKFDDLLKYLWAAHTSTLADNIKSFEDRYDYYSKAEAHFERSWVLAVDHLAAVLFPTTLIRSYKFQKGMPPRILLNTDVAPFISDFTAFQNVVLVLLNMLDNVDKSIGYLCTEKSNVYRDHSESSSRSYGNNS

SEQ ID NO: 843627 - protein, 124 aa, Homo sapiens
LSREMIRNIGLARCVGRGRYDYYSKAEAHFERSWVLAVDHLAAVLFPTTLIRSYKFQKGMPPRILLNTDVAPFISDFTAFQNVVLVLLNMLDNVDKSIGYLCTEKSNVYRDHSESSSRSYGNNS

SEQ ID NO: 843628 - protein, 481 aa, Homo sapiens
MAYNDTDRNQTEKLLKRVRELEQEVQRLKKEQAKNKEDSNIRENSSGAGKTKRAFDFSAHGRRHVALRIAYMGWGYQGFASQENTNNTIEEKLFEALTKTRLVESRQTSNYHRCGRTDKGVSAFGQVISLDLRSQFPRGRDSEDFNVKEEANAAAEEIRYTHILNRVLPPDIRILAWAPVEPSFSARFSCLERTYRYFFPRADLDIVTMDYAAQKYVGTHDFRNLCKMDVANGVINFQRTILSAQVQLVGQSPGEGRWQEPFQLCQFEVTGQAFLYHQVRCMMAILFLIGQGMEKPEIIDELLNIEKNPQKPQYSMAVEFPLVLYDCKFENVKWIYDQEAQEFNITHLQQLWANHAVKTHMLYSMLQGLDTVPVPCGIGPKMDGMTEWGNVKPSVIKQTSAFVEGVKMRTYKPLMDRPKCQGLESRIQHFVRRGRIEHPHLFHEEETKAKRDCNDTLEEDNTNLETPTKRVCVDTEIKSII

SEQ ID NO: 843629 - protein, 315 aa, Homo sapiens
MAYNDTDRNQTEKLLKRVRELEQEVQRLKKEQAKNKEDSNIRENSSGAGKTKRAFDFSAHGRRHVALRIAYMGWGYQGFASQENTNNTIEEKLFEALTKTRLVESRQTSNYHRCGRTDKGVSAFGQVISLDLRSQFPRGRDSEDFNVKEEANAAAEEIRYTHILNRVLPPDIRILAWAPVEPSFSARFSCLERTYRYFFPRADLDIVTMDYAAQKYVGTHDFRNLCKMDVANGVINFQRTILSAQVQLVGQSPGEGRWQEPFQLCQFEVTGQAFLYHQVRCMMAILFLIGQGMEKPEIIDELLNIEKNPQKPQYR

SEQ ID NO: 843630 - protein, 166 aa, Homo sapiens [sequence omitted]

SEQ ID NO: 843631 - protein, 372 aa, Homo sapiens
HSDSFLSRKRGAAGCRKVISLDLRSQFPRGRDSEDFNVKEEANAAAEEIRYTHILNRVLPPDIRILAWAPVEPSFSARFSCLERTYRYFFPRADLDIVTMDYAAQKYVGTHDFRNLCKMDVANGVINFQRTILSAQVQLVGQSPGEGRWQEPFQLCQFEVTGQAFLYHQVRCMMAILFLIGQGMEKPEIIDELLNIEKNPQKPQYSMAVEFPLVLYDCKFENVKWIYDQEAQEFNITHLQQLWANHAVKTHMLYSMLQGLDTVPVPCGIGPKMDGMTEWGNVKPSVIKQTSAFVEGVKMRTYKPLMDRPKCQGLESRIQHFVRRGRIEHPHLFHEEETKAKRDCNDTLEEDNTNLETPTKRVCVDTEIKSII

SEQ ID NO: 843632 - protein, 106 aa, Homo sapiens
MHRVCALRPVRAEAELVIGLQQHGEEVWCGWTDGPLRHMKYSKPSINQTCFSVLSLIFVQCVGFFPLMMSLVFYFWFICRLSPSLAMALLLCPPKESFTSLGLRNY

SEQ ID NO: 843633 - protein, 106 aa, Homo sapiens; identical to SEQ ID NO: 843632

SEQ ID NO: 843634 - protein, 216 aa, Homo sapiens
MRSLGALLLLLSACLAVSAGPVPTPPDNIQVQATCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECGPGEQEQSPSYIPEGRRAGVPLCQLVIGRALMGPAGFYNGPMARSL

SEQ ID NO: 843635 - protein, 133 aa, Homo sapiens
MESYVVHTNYDEYAIFLTKKFSRHHGPTITAKLYGRAPQLRETLLQDFRVVAQGVGIPEDSIFTMADRGECVLGSRDQKPSYFRESGGLVLPKKRKIRGGQLVLKYQEDSAIGYLPALVGGPQDSLLGIQAVG

SEQ ID NO: 843636 - protein, 235 aa, Homo sapiens
MESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 843637 - protein, 352 aa, Homo sapiens
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 843638 - protein, 235 aa, Homo sapiens; identical to SEQ ID NO: 843636

SEQ ID NO: 843639 - protein, 235 aa, Homo sapiens; identical to SEQ ID NO: 843636

SEQ ID NO: 843640 - protein, 334 aa, Homo sapiens
MRSLGALLLLLSACLAVSAGPVPTPPDNIQVQATCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 843641 - protein, 334 aa, Homo sapiens; identical to SEQ ID NO: 843640

SEQ ID NO: 843642 - protein, 272 aa, Homo sapiens
MTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 843643 - protein, 334 aa, Homo sapiens
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTVRGPCRAFIQLWAFDAVKGKCVLFPYGGCQGNGNKFYSEKECREYCGVPGDGDEELLRFSN

SEQ ID NO: 843644 - protein, 283 aa, Homo sapiens
AVGIRHEAEISMTSTRCRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 843645 - protein, 117 aa, Homo sapiens
MESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEGNEHLP

SEQ ID NO: 843646 - protein, 176 aa, Homo sapiens
MSLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTVRGPCRAFIQLWAFDAVKGKCVLFPYGGCQGNGNKFYSEKECREYCGVPGDGDEELLRFSN

SEQ ID NO: 843647 - protein, 155 aa, Homo sapiens
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRRS

SEQ ID NO: 843648 - protein, 161 aa, Homo sapiens
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGDEELLRFSN

SEQ ID NO: 843649 - protein, 110 aa, Homo sapiens
MRSLGALLLLLSACLAVSAGPVPTPPDNIQVQENFNISRIYGKWYNLAIGSTCPWLKKIMDRMTVSTLVLGEGATEAEISMTSTRWRKGVCEKEKTPFWGGGENPLFFFF

SEQ ID NO: 843650 - protein, 352 aa, Homo sapiens; identical to SEQ ID NO: 843637

SEQ ID NO: 843651 - protein, 132 aa, Homo sapiens
MESYVVHTNYDEYAIFLTKKFSRHHGPTITAKLYGRAPQLRETLLQDFRVVAQGVGIPEDSIFTMADRGDGVPGSRNRAHLNPRGRRLGYPRKEDQGWATGTEVPGRILQLGTCRAWWEGPQDSLLGIQAVG

SEQ ID NO: 843652 - protein, 214 aa, Homo sapiens
MRSLGALLLLLSACLAVSAGPVPTPPDNIQVQATCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGGRLELRDFIFTMADRGECVLGSRDQKPSYFRESGGLVLPKKRKIRGGQLVLKYQEEFCNWLLAGPGGRTTGFFMGIQAVG

SEQ ID NO: 843653 - protein, 235 aa, Homo sapiens; identical to SEQ ID NO: 843636

SEQ ID NO: 843654 - protein, 235 aa, Homo sapiens; identical to SEQ ID NO: 843636

SEQ ID NO: 843655 - protein, 301 aa, Homo sapiens
MESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDKSCCAFQLQLGRFEVKGWPMFFPGSFESNRQHLGPKFYTSSPLSSFIIFFSLSSLVVFFYPLFLFLIFFFIIFI

SEQ ID NO: 843656 - protein, 217 aa, Homo sapiens
MESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTVRGPCRAFIQLWAFDAVKGKCVLFPYGGCQGNGNKFYSEKECREYCGVPGDGDEELLRFSN

SEQ ID NO: 843657 - protein, 257 aa, Homo sapiens
MESYVVHTNYDEYAIFLTKKFSRHHGPTITAKLYGRAPQLRETLLQDFRVVAQGVGIPEDSIFTMADRGECVPGEQEPEPILIPGYRKAIAGKESATASSLSLPRRRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 843658 - protein, 192 aa, Homo sapiens
MDPPLLPSSTGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 843659 - protein, 194 aa, Homo sapiens
MSLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 843660 - protein, 154 aa, Homo sapiens
MSDRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 843661 - protein, 176 aa, Homo sapiens; identical to SEQ ID NO: 843646

SEQ ID NO: 843662 - protein, 105 aa, Homo sapiens
DQQSQGFLKFHASLHSTAACNLPIVRGPCRAFIQLWAFDAVKGKCVLFPYGGCQGNGNKFYSEKECREYCGVPGDGRQPCRVPGWAEGLLESRWESPGRSRGLES

SEQ ID NO: 843663 - protein, 186 aa, Homo sapiens
GQKEFKPNLCLRTDWVCSVDFQASFARGFVKDWLSFKPQGSGRKQSATSSPHPAALRALDSAGRSLLRRNGAREGGLSLTLAVCQVDDILGEGSDDSDSEKRRPEEQEEEPQPRKPGTRRERTLGAPASSERSAAGGRGPRGHKRKLNEEDAASESSRESSNEDEGSSSEADEMAKALEAELNDLM

SEQ ID NO: 843664 - protein, 894 aa, Homo sapiens
GLCRRGRRCALSAAQAPYRPPARPLSAMEVPAAGRVPAEGAPTAAVAEVRCPGPAPLRLLEWRVAAGAAVRIGSVLAVFEAAASAQSSGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRWTTSLEKAATTATARRGGLRSRRRSPSPGSQGPAGSGRSGHLRPARGARQGAGGPEATRGS

SEQ ID NO: 843665 - protein, 277 aa, Homo sapiens
PPSPLPPPYLVAGLIGRGLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRAVPPPQPQMFGEELPDAQDGEQPGPSRRKRQPSMSETMPLYTLCKEDLESMDKEVDDILGEGSDDSDSEKRRPEEQEEEPQPRKPGTRRERTLGAPASSERSAAGGRGPRGHKRKLNEEDAASESSRESSNEDEGSSSEADEMAKALEAELNDLM

SEQ ID NO: 843666 - protein, 138 aa, Homo sapiens
MSGRNVHLQQVNTCFVSGVLVCNRAGASSPALGLCCPHVCDVALGGGLCVSLTRELCRLVLKPRKPLPKCRPGGDPALCVCHKHLTPCLLLCRGHKRKLNEEDAASESSRESSNEDEGSSSEADEMAKALEAELNDLM

SEQ ID NO: 843667 - protein, 130 aa, Homo sapiens
EVQPSEGLGGVQPGEGPGGVQLGEGPEPCRGAVQVKALVGCSRVRALSPGGVQPGEGPGGCSRMWALSLQCWPEQPDAAGSPAGTEKVLQAQECGHLHVVNPDWLWSCLERWDKVEEQLFPLRDDHTKAQ

SEQ ID NO: 843668 - protein, 988 aa, Homo sapiens
GLCRRGRRCALSAAQAPYRPPARPLSAMEVPAAGRVPAEGAPTAAVAEVRCPGPAPLRLLEWRVAAGAAVRIGSVLAVFEAAASAQSSGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRAVPPPQPQMFGEELPDAQDGEQPGPSRRKRQPSMSETMPLYTLCKEDLESMDKEVDDILGEGSDDSDSEKRRPEEQEEEPQPRKPGTRRERTLGAPASSERSAAGGRGPRGHKRKLNEEDAASESSRESSNEDEGSSSEADEMAKALEAELNDLM

SEQ ID NO: 843669 - protein, 964 aa, Homo sapiens
GLCRRGRRCALSAAQAPYRPPARPLSAMEVPAAGRVPAEGAPTAAVAEVRCPGPAPLRLLEWRVAAGAAVRIGSVLAVFEAAASAQSSGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAPPRGTHPAPGSQTRGTSGPLPRPPPAAKSWQALLSPRDPVRRVAGWHRDSGLPRVPRALTWTLTYPATARAAVSPRARSPPPPPLMAKRGEKRPAEAEGCPRGSRGAGTGQFPGPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRAVPPPQPQMFGEELPDAQDGEQPGPSRRKRQPSMSETMPLYTLCKEDLESMDKEVDDILGEGSDDSDSEKRRPEEQEEEPQPRKPGTRRERTLGAPASSERSAAGGRGPRGHKRKLNEEDAASESSRESSNEDEGSSSEADEMAKALEAELNDLM

SEQ ID NO: 843670 - protein, 1008 aa, Homo sapiens
GLCRRGRRCALSAAQAPYRPPARPLSAMEVPAAGRVPAEGAPTAAVAEVRCPGPAPLRLLEWRVAAGAAVRIGSVLAVFEAAASAQSSGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRAVPPPQPQMFGEELPDAQDGEQPGPSRRKRQPSMSETMPLYTLCKEDLESMDKEVDDILGEGSDDSDSEKRRPEEQEEEPQPRKPGTRRERTLGAPASSERSAAGGRGPSSQNGVRWRKPNGRMGAGFSRNSRQRVCGGKEMTDEFVNCQKLVAVATGGQTRGPDSVVSVSRDWK

SEQ ID NO: 843671 - protein, 168 aa, Homo sapiens
RLGPGLGPSPTVRRAGGLSLAVGPATARVLAAGRRWGGRAEDEEFEAFRGACRGVRLCGTLRRAPSAGAPGSRFVAEGSTRDAPPVAAVASFGVRDLLRGWKAARRRGALHSPGGKPARTRVRTHGAAGGRGGSGPRGRRASREAILLHLPVILKANRSQTRAQRLSK

SEQ ID NO: 843672 - protein, 168 aa, Homo sapiens; identical to SEQ ID NO: 843671

SEQ ID NO: 843673 - protein, 1351 aa, Homo sapiens
CADAVAAAAAAAAATAFAATVSAAAVLALPLGASIVPAAPGPETGHLGGSRNGRRPTELRPQGAGGTRSGRGQLRNPGEPGPKRGAAGGRGGEVYGLRSWGSPFPARLSPPTSPSGVGAPAGAPGDEARTRGGRCDSMGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLEVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKGLGPNMSSTPAHEVGRRTSVLFSKKNPKTAGPPKRPGRPPKNRESQMTPSHGGSPVGPPQLPIMSSLRQRKRGRSPRPSSSSDSDSDKSTEDPPMDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSMVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 843674 - protein, 1385 aa, Homo sapiens
CADAVAAAAAAAAATAFAATVSAAAVLALPLGASIVPAAPGPETGHLGGSRNGRRPTELRPQGAGGTRSGRGQLRNPGEPGPKRGAAGGRGGEVYGLRSWGSPFPARLSPPTSPSGVGAPAGAPGDEARTRGGRCDSMGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLEVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKGLGPNMSSTPAHEVGRRTSVLFSKKNPKTAGPPKRPGRPPKNRESQMTPSHGGSPVGPPQLPIMSSLRQRKRGRSPRPSSSSDSDSDKSTEDPPMDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSSKFPCPRPGMLGTQCQGLASPPAADPPPLPHSCEVVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 843675 - protein, 1423 aa, Homo sapiens
CADAVAAAAAAAAATAFAATVSAAAVLALPLGASIVPAAPGPETGHLGGSRNGRRPTELRPQGAGGTRSGRGQLRNPGEPGPKRGAAGGRGGEVYGLRSWGSPFPARLSPPTSPSGVGAPAGAPGDEARTRGGRCDSMGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLEVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDGGDISHTHIRGQCRGWTAFQKSPPGSRQCRQKAARLSSGKLSPGMLPKKPDWVNGSSARHSTSWCCYFTAVPAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKGLGPNMSSTPAHEVGRRTSVLFSKKNPKTAGPPKRPGRPPKNRESQMTPSHGGSPVGPPQLPIMSSLRQRKRGRSPRPSSSSDSDSDKSTEDPPMDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSMVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 843676 - protein, 1113 aa, Homo sapiens
CADAVAAAAAAAAATAFAATVSAAAVLALPLGASIVPAAPGPETGHLGGSRNGRRPTELRPQGAGGTRSGRGQLRNPGEPGPKRGAAGGRGGEVYGLRSWGSPFPARLSPPTSPSGVGAPAGAPGDEARTRGGRCDSMGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLEVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKGLGPNMSSTPAHEVGRRTSVLFSKKNPKTAGPPKRPGRPPKNRESQMTPSHGGSPVGPPQLPIMSSLALSAAGLYRTLQGPMAVQRKEREGPQVRKSSRDLTAL

SEQ ID NO: 843677 - protein, 1357 aa, Homo sapiens
CADAVAAAAAAAAATAFAATVSAAAVLALPLGASIVPAAPGPETGHLGGSRNGRRPTELRPQGAGGTRSGRGQLRNPGEPGPKRGAAGGRGGEVYGLRSWGSPFPARLSPPTSPSGVGAPAGAPGDEARTRGGRCDSMGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLEVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVTELDEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKGLGPNMSSTPAHEVGRRTSVLFSKKNPKTAGPPKRPGRPPKNRESQMTPSHGGSPVGPPQLPIMSSLRQRKRGRSPRPSSSSDSDSDKSTEDPPMDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSMVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 843678 - protein, 1256 aa, Homo sapiens
CADAVAAAAAAAAATAFAATVSAAAVLALPLGASIVPAAPGPETGHLGGSRNGRRPTELRPQGAGGTRSGRGQLRNPGEPGPKRGAAGGRGGEVYGLRSWGSPFPARLSPPTSPSGVGAPAGAPGDEARTRGGRCDSMGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLEVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSMVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 843679 - protein, 39 aa, Homo sapiens
IINITTSSNSCSRHHRQYLQMGNRPAAKMKALTIWPEEF

SEQ ID NO: 843680 - protein, 402 aa, Homo sapiens
MYREQMNLTSLDPPLQLRLEASWVQFHLGINRHGLYSRSSPVVSKLLQDMRHFPTISADYSQDEKALLGACDCTQIVKPSGVHLKLVLRFSDFGKGHVQTHEQRDEETPVDFFYFIDFQRHNAEIAAFHLDRILDFRRVPPTVGRIVNVTKEILEVTKNEILQSVFFVSPASNVCFFAKCPYMCKTEYAVCGNPHLLEGSLSAFLPSLNLAPRLSVPNPWIRSYTLAGKEEWEVNPLYCDTVKQIYPYNNSQRLLNVIDMAIFDFLIGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQSAPDSGQANLTS

SEQ ID NO: 843681 - protein, 402 aa, Homo sapiens; identical to SEQ ID NO: 843680

SEQ ID NO: 843682 - protein, 402 aa, Homo sapiens; identical to SEQ ID NO: 843680

SEQ ID NO: 843683 - protein, 258 aa, Homo sapiens
NLRLGTRLGGPESVAAAARAFPFTAPKELERQQRRRFRFHHLFLFPSLRTPCRVSVSLQPWLWKATEVMAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWRCRRVGADLHL

SEQ ID NO: 843684 - protein, 210 aa, Homo sapiens
NPENLATLERYVETQAKENAYDLDVYLSIPLSKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWRCRRVGADLHL

SEQ ID NO: 843685 - protein, 210 aa, Homo sapiens; identical to SEQ ID NO: 843684

SEQ ID NO: 843686 - protein, 225 aa, Homo sapiens
NLRLGTRLGGPESVAAAARAFPFTAPKELERQQRRRFRFHHLFLFPSLRTPCRVSVSLQPWLWKATEVMAMFEQMRANVGKLLKGIDRYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWRCRRVGADLHL

SEQ ID NO: 843687 - protein, 255 aa, Homo sapiens
EEEVTWQPESVAAAARAFPFTAPKELERQQRRRFRFHHLFLFPSLRTPCRVSVSLQPWLWKATEVMAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWRCRRVGADLHL

SEQ ID NO: 843688 - protein, 255 aa, Homo sapiens; identical to SEQ ID NO: 843687

SEQ ID NO: 843689 - protein, 229 aa, Homo sapiens
EEEVTWQPESVAAAARAFPFTAPKELERQQRRRFRFHHLFLFPSLRTPCRVSVSLQPWLWKATEVMAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKYSQLKVWMSKYGWRCRRVGADLHL

SEQ ID NO: 843690 - protein, 239 aa, Homo sapiens
EEEVTWQPESVAAAARAFPFTAPKELERQQRRRFRFHHLFLFPSLRTPCRVSVSLQPWLWKATEVMAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYHSQLKVWMSKYGWRCRRVGADLHL

SEQ ID NO: 843691 - protein, 232 aa, Homo sapiens
EEEVTWQPESVAAAARAFPFTAPKELERQQRRRFRFHHLFLFPSLRTPCRVSVSLQPWLWKATEVMAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSG

SEQ ID NO: 843692 - protein, 229 aa, Homo sapiens; identical to SEQ ID NO: 843689

SEQ ID NO: 843693 - protein, 232 aa, Homo sapiens
EEEVTWQPESVAAAARAFPFTAPKELERQQRRRFRFHHLFLFPSLRTPCRVSVSLQPWLWKATEVMAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWSLPLSPSLECNGVISAHHNLHLLGSSDSPASASSVVGITGMCHHALLIL

SEQ ID NO: 843694 - protein, 103 aa, Homo sapiens
MIDQAHQEERPIRQILYLGDLLETCHFQAFWQALDENMDLLEGITGFEDSVRKFICHVVGITYQHIDRWLLAEMLGDLSDSQLKVWMSKYGWRCRRVGADLHL

SEQ ID NO: 843695 - protein, 190 aa, Homo sapiens
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWRCRRVGADLHL

SEQ ID NO: 843696 - protein, 85 aa, Homo sapiens
SKTSMFSSRASRRPGNGRSPAGPRGTTGFEDSVRKFICHVVGITYQHIDRWLLAEMLGDLSDSQLKVWMSKYGWRCRRVGADLHL

SEQ ID NO: 843697 - protein, 255 aa, Homo sapiens; identical to SEQ ID NO: 843687

SEQ ID NO: 843698 - protein, 103 aa, Homo sapiens; identical to SEQ ID NO: 843694

SEQ ID NO: 843699 - protein, 255 aa, Homo sapiens; identical to SEQ ID NO: 843687

SEQ ID NO: 843700 - protein, 258 aa, Homo sapiens; identical to SEQ ID NO: 843683

SEQ ID NO: 843701 - protein, 255 aa, Homo sapiens; identical to SEQ ID NO: 843687

SEQ ID NO: 843702 - protein, 304 aa, Homo sapiens
EEEVTWQPESVAAAARAFPFTAPKELERQQRRRFRFHHLFLFPSLRTPCRVSVSLQPWLWKATEVMAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSVRTRGYGGEHIAGAKVGDIFSSPRHYPPREDQSATTAPTVHFGDTNGRCRRRLSPRESRDIGITKNTKRRTTQ

SEQ ID NO: 843703 - protein, 219 aa, Homo sapiens
EEEVTWQPESVAAAARAFPFTAPKELERQQRRRFRFHHLFLFPSLRTPCRVSVSLQPWLWKATEVMAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKCKSLSEAGLPKGKG

SEQ ID NO: 843704 - protein, 200 aa, Homo sapiens
EEEVTWQPESVAAAARAFPFTAPKELERQQRRRFRFHHLFLFPSLRTPCRVSVSLQPWLWKATEVMAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWVTSLGSRGRGDGRAMWS

SEQ ID NO: 843705 - protein, 86 aa, Homo sapiens
RVIYPHPEKNKKVLFVDAADIRSKVADSLVHIKSLGPVFKDRPFLLYPSYKKVTVYINRNSSLGFGEPVVACVGYKKFQNSNFFIK

SEQ ID NO: 843706 - protein, 705 aa, Homo sapiens
MGESPASVVLNASGGLFSLKMETLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKQTLEMNLTNLVKRNSELENQMAKLIQICQQVEVNTAMHEAKLMEECDELVEIIQQRKQMIAVKIKETKVMKLRKLAQQVANCRQCLERSTVLINQAEHILKENDQARFLQSAKNIAERVAMATASSQVLIPDINFNDAFENFALDFSREKKLLEGLDYLTAPNPPSIREELCTASHDTITVHWISDDEFSISSYELQYTIFTGQANFISLYNSVDSWMIVPNIKQNHYTVHGLQSGTRYIFIVKAINQAGSRNSEPTRLKTNSQPFKLDPKMTHKKLKISNDGLQMEKDESSLKKSHTPERFSGTGCYGAAGNIFIDSGCHYWEVVMGSSTWYAIGIAYKSAPKNEWIGKNASSWVFSRCNSNFVVRHNNKEMLVDVPPHLKRLGVLLDYDNNMLSFYDPANSLHLHTFDVTFILPVCPTFTIWNKSLMILSGLPAPDFIDYPERQECNCRPQESPYVSGMKTCH

SEQ ID NO: 843707 - protein, 362 aa, Homo sapiens
NTENQSIETPLHGFRVAMATASSQVLIPDINFNDAFENFALDFSREKKLLEGLDYLTAPNPPSIREELCTASHDTITVHWISDDEFSISSYELQYTIFTGQANFISLYNSVDSWMIVPNIKQNHYTVHGLQSGTRYIFIVKAINQAGSRNSEPTRLKTNSQPFKLDPKMTHKKLKISNDGLQMEKDESSLKKSHTPERFSGTGCYGAAGNIFIDSGCHYWEVVMGSSTWYAIGIAYKSAPKNEWIGKNASSWVFSRCNSNFVVRHNNKEMLVDVPPHLKRLGVLLDYDNNMLSFYDPANSLHLHTFDVTFILPVCPTFTIWNKSLMILSGLPAPDFIDYPERQECNCRPQESPYVSGMKTCH

SEQ ID NO: 843708 - protein, 735 aa, Homo sapiens
MGESPASVVLNASGGLFSLKMETLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKQTLEMNLTNLVKRNSELENQMAKLIQICQQVEVNTAMHEAKLMEECDELVEIIQQRKQMIAVKIKETKVMKLRKLAQQVANCRQCLERSTVLINQAEHILKENDQARFLQSAKNIAERVAMATASSQVLIPDINFNDAFENFALDFSREKKLLEGLDYLTAPNPPSIREELCTASHDTITVHWISDDEFSISSYELQYTIFTGQANFISKSWCSWGLWPEIRKCKEAVSCSRLAGAPRGLYNSVDSWMIVPNIKQNHYTVHGLQSGTRYIFIVKAINQAGSRNSEPTRLKTNSQPFKLDPKMTHKKLKISNDGLQMEKDESSLKKSHTPERFSGTGCYGAAGNIFIDSGCHYWEVVMGSSTWYAIGIAYKSAPKNEWIGKNASSWVFSRCNSNFVVRHNNKEMLVDVPPHLKRLGVLLDYDNNMLSFYDPANSLHLHTFDVTFILPVCPTFTIWNKSLMILSGLPAPDFIDYPERQECNCRPQESPYVSGMKTCH

SEQ ID NO: 843709 - protein, 720 aa, Homo sapiens
FLQDDRALEKRLLESAGESPASVVLNASGGLFSLKMETLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKQTLEMNLTNLVKRNSELENQMAKLIQICQQVEVNTAMHEAKLMEECDELVEIIQQRKQMIAVKIKETKVMKLRKLAQQVANCRQCLERSTVLINQAEHILKENDQARFLQSAKNIAERVAMATASSQVLIPDINFNDAFENFALDFSREKKLLEGLDYLTAPNPPSIREELCTASHDTITVHWISDDEFSISSYELQYTIFTGQANFISLYNSVDSWMIVPNIKQNHYTVHGLQSGTRYIFIVKAINQAGSRNSEPTRLKTNSQPFKLDPKMTHKKLKISNDGLQMEKDESSLKKSHTPERFSGTGCYGAAGNIFIDSGCHYWEVVMGSSTWYAIGIAYKSAPKNEWIGKNASSWVFSRCNSNFVVRHNNKEMLVDVPPHLKRLGVLLDYDNNMLSFYDPANSLHLHTFDVTFILPVCPTFTIWNKSLMILSGLPAPDFIDYPERQECNCRPQESPYVSGMKTCH

SEQ ID NO: 843710 - protein, 755 aa, Homo sapiens
GGAAVAVAGHARLRARLLKHGGGGVKLGAGSRDRWDRISLFSPTRLEETTPNRDTMGQTVNEDSMDVKKENQEKTPQSSTSSVQRDDFHWEEYLKETGSISAPSECFRQSQIPPVNDFKVGMKLEARDPRNATSVCIATVIGITGARLRLRLDGSDNRNDFWRLVDSPDIQPVGTCEKEGDLLQPPLGYQMNTSSWPMFLLKTLNGSEMASATLFKKEPPKPPLNNFKVGMKLEAIDKKNPYLICPATIGDVKGDEVHITFDGWSGAFDYWCKYDSRDIFPAGWCRLTGDVLQPPGTSVPIVKNIAKTESSPSEASQHSMQSPQKTTLILPTQQVRRSSRIKPPGPTAVPKRSSSVKNITPRKKGPNSGKKEKPLPVICSTSAASLKSLTRDRGMLYKDVASGPCKIVMSTVCVYVNKHGNFGPHLDPKRIQQLPDHFGPGPVNVVLRRIVQACVDCALETKTVFGYLKPDNRGGEVITASFDGETHSIQLPPVNSASFALRFLENFCHSLQCDNLLSSQPFSSSRGHTHSSAEHDKNQSAKEDVTERQSTKRSPQQTVPYVVPLSPKLPKTKEYASEGEPLFAGGSAIPKEENLSEDSKSSSLNSGNYLNPACRNPMYIHTSVSQDFSRSVPGTTSSPLVGDISPKSSPHEVKFQMQRKSEAPSYIAVPDPSVLKQGFSKDPSTWSVDEVIQFMKHTDPQISGPLADLFRQHEIDGKALFLLKSDVMMKYMGLKLGPALKLCYYIEKLKEGKYS

SEQ ID NO: 843711 - protein, 664 aa, Homo sapiens
GGAAVAVAGHARLRARLLKHGGGGVKLGAGSRDRWDRISLFSPTRLEETTPNRDTMGQTVNEDSMDVKKENQEKTPQSSTSSVQRDDFHWEEYLKETGSISAPSECFRQSQIPPVNDFKVGMKLEARDPRNATSVCIATVIGITGARLRLRLDGSDNRNDFWRLVDSPDIQPVGTCEKEGDLLQPPLGYQMNTSSWPMFLLKTLNGSEMASATLFKKEPPKPPLNNFKVGMKLEAIDKKNPYLICPATIGDVKGDEVHITFDGWSGAFDYWCKYDSRDIFPAGWCRLTGDVLQPPGTSVPIVKNIAKTESSPSEASQHSMQSPQKTTLILPTQQVRRSSRIKPPGPTAVPKRSSSVKNITPRKKGPNSGKKEKPLPVICSTSAASLKSLTRDRGMLYKDVASGPCKIVMSTVCVYVNKHGNFGPHLDPKRIQQLPDHFGPGPVNVVLRRIVQACVDCALETKTVFGYLKPDNRGGEVITASFDGETHSIQLPPVNSASFALRFLENFCHSLQCDNLLSSQPFSSSRGHTHSSAEHDKNQSAKEDVTERQSTKRSPQQTVPYVVPLSPKLPKTKEYASEGEPLFAGGSAIPKEENLSEDSKSSSLNSGNYLNPACRNPMYIHTSVSQDFSRSVPGTTSSPLVGDISPKSSPHEVKFQMQRKSEGN

SEQ ID NO: 843712 - protein, 1150 aa, Homo sapiens
LLEDAERCRHKMQTASTLISGLAGEKERWTEQSQEFAAQTKRLVGDVLLATAFLSYSGPFNQEFRDLLLNDWRKEMKARKIPFGKNLNLSEMLIDAPTISEWNLQGLPNDDLSIQNGIIVTKASRYPLLIDPQTQGKIWIKNKESRNELQITSLNHKYFRNHLEDSLSLGRPLLIEDVGEELDPALDNVLERNFIKTGSTFKVKVGDKEVDVLDGFRLYITTKLPNPAYTPEISARTSIIDFTVTMKGLEDQLLGRVILTEKQELEKERTHLMEDVTANKRRMKELEDNLLYRLTSTQGSLVEDESLIVVLSNTKRTAEEVTQKLEISAETEVQINSAREEYRPVATRGSILYFLITEMRLVNEMYQTSLRQFLGLFDLSLARSVKSPITSKRIANIIEHMTYEVYKYAARGLYEEHKFLFTLLLTLKIDIQRNRVKHEEFLTLIKGGASLDLKACPPKPSKWILDITWLNLVELSKLRQFSDVLDQISRNEKMWKIWFDKENPEEEPLPNAYDKSLDCFRRLLLIRSWCPDRTIAQARKYIVDSMGEKYAEGVILDLEKTWEESDPRTPLICLLSMGSDPTDSIIALGKRLKIETRYVSMGQGQEVHARKLLQQTMANGGWALLQNCHLGLDFMDELMDIIIETELVHDAFRLWMTTEVHKQFPITLLQMSIKFANDPPQGLRAGLKRTYSGVSQDLLDVSSGSQWKPMLYAVAFLHSTVQERRKFGALGWNIPYEFNQADFNATVQFIQNHLDDMDVKKGVSWTTIRYMIGEIQYGGRVTDDYDKRLLNTFAKVWFSENMFGPDFSFYQGYNIPKCSTVDNYLQYIQSLPAYDSPEVFGLHPNADITYQSKLAKDVLDTILGIQPKDTSGGGDETREAVVARLADDMLEKLPPDYVPFEVKERLQKMGPFQPMNIFLRQEIDRMQRVLSLVRSTLTELKLAIDGTIIMSENLRDALDCMFDARIPAWWKKASWVSSTLGFWFTELIERNSQFTSWVFNGRPHCFWMTGFFNPQGFLTAMRQEITRANKGWALDNMVLCNEVTKWMKDDISAPPTEGVYVYGLYLEGAGWDKRNMKLIESKPKVLFELMPVIRIYAENNTLRDPRFYSCPIYKKPVRTDLNYIAAVDLRTAQTPEHWVLRGVALLCDVK

SEQ ID NO: 843713 - protein, 1150 aa, Homo sapiens; identical to SEQ ID NO: 843712

SEQ ID NO: 843714 - protein, 188 aa, Homo sapiens
RRNSVPFIFNTHHLLEYSHLSEPAKPAHSQNQSNFSSYSSKGKPPEADGVDRSFGEKRYEPIQATPPPPPLPSQYAQPSQPVTSASLHIHSKGAHGEGNSVSFGIAISGGRDNPHFQSGETSIVISDVLKGGPAEGQLQENDRVAMVNGVSMDNVEHAFAVQQLRKSGKNAKITIRRKKKVQIPVSRP

SEQ ID NO: 843715 - protein, 1768 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRAVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 843716 - protein, 1688 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRAVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 843717 - protein, 1559 aa, Homo sapiens
RARRLTGSMDELWELIHKEEQTLPQDFESLKQEEIPYEAGLQQLQWSYLYSVHYCCELMLATARMSRSSWFVGPSCRDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRAVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 843718 - protein, 1145 aa, Homo sapiens
ATQTKLPMTSMKEWTSRSSHSAAVSDSGTSYAQVAREKLTGTDQIFSHAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 843719 - protein, 1115 aa, Homo sapiens
DYEFRSPGTPWQPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 843720 - protein, 496 aa, Homo sapiens
ELGPIVIKRRKDVNRHGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 843721 - protein, 1768 aa, Homo sapiens; identical to SEQ ID NO: 843715

SEQ ID NO: 843722 - protein, 1755 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRAVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGDPKTWQNKCLPGDPNYLVGANCVSVLIDHF

SEQ ID NO: 843723 - protein, 419 aa, Homo sapiens [sequence omitted]

SEQ ID NO: 843724 - protein, 167 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERTS

SEQ ID NO: 843725 - protein, 131 aa, Homo sapiens
LKCEFFIQVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESS

SEQ ID NO: 843726 - protein, 1748 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRAVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCDPKTWQNKCLPGDPNYLVGANCVSVLIDHF

SEQ ID NO: 843727 - protein, 1755 aa, Homo sapiens; identical to SEQ ID NO: 843722

SEQ ID NO: 843728 - protein, 1731 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRAVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDAVLIDHF

SEQ ID NO: 843729 - protein, 659 aa, Homo sapiens
AAALADILSLSSAARGSSDPETPRRWPARSSRHRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 843730 - protein, 114 aa, Homo sapiens [sequence omitted]

SEQ ID NO: 843731 - protein, 1748 aa, Homo sapiens; identical to SEQ ID NO: 843726

SEQ ID NO: 843732 - protein, 1697 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRAVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGKCVYFSP

SEQ ID NO: 843733 - protein, 92 aa, Homo sapiens
TSDYEDTDTEGGAYTDQELDETLNDEVGTPPESAITRSSEPVREDSSGMHHENQTYPPYSPQAQPQPIHRIDSPGFKPASQQVSSKHSTFCR

SEQ ID NO: 843734 - protein, 83 aa, Homo sapiens
MEEMVVSCVIKHLNLVDALQSLINFQYQEEHAEEYDLLCKIMGETFKKLNAMERQLQSVAELEQKWQSEVDDAMQGKLENNMP

SEQ ID NO: 843735 - protein, 78 aa, Homo sapiens
VISYCFLFVGTEAVSSASDLSDEGLGQHLDPQSKDSQGSNCSGHLLYPSVVPMVKSTAGPSSDHQRALAYCVHPRIRL

SEQ ID NO: 843736 - protein, 101 aa, Homo sapiens
SGHPHPRRGWGLGWGLWRRRSRGVLTRSDGLSVAVSPELSFLLVCKACFASSSPSAMIVHFLRPPQPCRTAYNLGFITTYIRIEVHEQKICPSGIPNAKLK

SEQ ID NO: 843737 - protein, 435 aa, Homo sapiens
MAAPLVLVLVVAVTVRAALFRSSLAEFISERVEVVSPLSSWKRVVEGLSLLDLGVSPYSGAVFHETPLIIYLFHFLIDYAELVFMITDALTAIALYFAIQDFNKVVFKKQKLLLELDQYAPDVAELIRTPMEMRYIPLKVALFYLLNPYTILSCVAKSTCAINNTLIAFFILTTIKGSAFLSAIFLALATYQSLYPLTLFVPGLLYLLQRQYIPVKMKSKAFWIFSWEYAMMYVGSLVVIICLSFFLLSSWDFIPAVYGFILSVPDLTPNIGLFWYFFAEMFEHFSLFFVCVFQINVFFYTIPLAIKLKEHPIFFMFIQIAVIAIFKSYPTVGDVALYMAFFPVWNHLYRFLRNIFVLTCIIIVCSLLFPVLWHLWIYAGSANSNFFYAITLTFNVGQILLISDYFYAFLRREYYLTHGLYLTAKDGTEAMLVLK

SEQ ID NO: 843738 - protein, 435 aa, Homo sapiens; identical to SEQ ID NO: 843737

SEQ ID NO: 843739 - protein, 435 aa, Homo sapiens; identical to SEQ ID NO: 843737

SEQ ID NO: 843740 - protein, 245 aa, Homo sapiens
MAAPLVLVLVVAVTVRAALFRSSLAEFISERVEVVSPLSSWKRVVEGLSLLDLGVSPYSGAVFHETPLIIYLFHFLIDYAELVFMITDALTAIALYFAIQDFNKVVFKKQKLLLELDQYAPDVAELIRTPMEMRYIPLKVALFYLLNPYTILSCVAKSTCAINNTLIAFFILTTIKAAVHTCENEEQSLLDLFLGVCHDVCGKPSGNHLPLLLPSQLLGFHPRSLWLYGAPHLLHVYPDRCHRHL

SEQ ID NO: 843741 - protein, 487 aa, Homo sapiens
MAAPLVLVLVVAVTVRAALFRSSLAEFISERVEVVSPLSSWKRVVEGLSLLDLGVSPYSGAVFHETPLIIYLFHFLIDYAELVFMITDALTAIALYFAIQDFNKVVFKKQKLLLELDQYAPDVAELIRTPMEMRYIPLKVALFYLLNPYTILSCVAKSTCAINNTLIAFFILTTIKGSAFLSAIFLALATYQSLYPLTLFVPGLLYLLQVLSINNCCHQKQKPSLLTKEHYPPPKFAKRIKSKIDQASGYSCNLQEILKTKRQYIPVKMKSKAFWIFSWEYAMMYVGSLVVIICLSFFLLSSWDFIPAVYGFILSVPDLTPNIGLFWYFFAEMFEHFSLFFVCVFQINVFFYTIPLAIKLKEHPIFFMFIQIAVIAIFKSYPTVGDVALYMAFFPVWNHLYRFLRNIFVLTCIIIVCSLLFPVLWHLWIYAGSANSNFFYAITLTFNVGQILLISDYFYAFLRREYYLTHGLYLTAKDGTEAMLVLK

SEQ ID NO: 843742 - protein, 118 aa, Homo sapiens
MLTLGLSIQGGHCSRESMPERACQANCEPSVFAVLRNIFVLTCIIIVCSLLFPVLWHLWIYAGSANSNFFYAITLTFNVGQILLISDYFYAFLRREYYLTHGLYLTAKDGTEAMLVLK

SEQ ID NO: 843743 - protein, 77 aa, Homo sapiens
IVIQSQAGAFLSSNNTCQQFRILGLGGGTQQRLTPSLSPQILLISDYFYAFLRREYYLTHGLYLTAKDGTEAMLVLK

SEQ ID NO: 843744 - protein, 150 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWNNCAFLESSFKN

SEQ ID NO: 843745 - protein, 184 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 843746 - protein, 184 aa, Homo sapiens; identical to SEQ ID NO: 843745

SEQ ID NO: 843747 - protein, 133 aa, Homo sapiens
MLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 843748 - protein, 166 aa, Homo sapiens
MREYKLVVLGSGGVGKSALTVQFVQGIFVEKYDPTIEDSYRKQVEVDAQQCMLEILDTAGTEQFTAMRDLYMKDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 843749 - protein, 208 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARSLKNCCPIQQCQHSNFVKPTNILNGLSCGGTL

SEQ ID NO: 843750 - protein, 136 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDIFYDLVRQINRKTPVPGKARKKSSCQLL

SEQ ID NO: 843751 - protein, 184 aa, Homo sapiens; identical to SEQ ID NO: 843745

SEQ ID NO: 843752 - protein, 184 aa, Homo sapiens; identical to SEQ ID NO: 843745

SEQ ID NO: 843753 - protein, 184 aa, Homo sapiens; identical to SEQ ID NO: 843745

SEQ ID NO: 843754 - protein, 184 aa, Homo sapiens; identical to SEQ ID NO: 843745

SEQ ID NO: 843755 - protein, 118 aa, Homo sapiens
MRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 843756 - protein, 115 aa, Homo sapiens
MLEILDTAGTEQFTAMRDLYMKDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 843757 - protein, 184 aa, Homo sapiens; identical to SEQ ID NO: 843745

SEQ ID NO: 843758 - protein, 206 aa, Homo sapiens
RFQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACECYISIADWAAVQEWQNAIHDLKKSTSSTSLNLKADFNYIKSLSSFESGKFVECTEQLELLPGENINLLAGGSKEKI

SEQ ID NO: 843759 - protein, 78 aa, Homo sapiens
RFQGNELEVTIMMVVEALCELHCPEAIQGIAVWSSSIVGKNLLWINSVAQQAEGSIEACYKSLHQEASSVCSLVSSNT

SEQ ID NO: 843760 - protein, 1737 aa, Homo sapiens
TFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNKEFKHSNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 843761 - protein, 560 aa, Homo sapiens
MLYQRIPQENSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 843762 - protein, 535 aa, Homo sapiens
LYGSCLEILVALDQFAYWSLSVQNRVVTVDKSLRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 843763 - protein, 94 aa, Homo sapiens
MVLLLQSQRQYIFEYDSSDRLLAVTMPSVARHSMSTHTSIGYIRNIYNPPESNASVIFDYSDDGRILKTSFLGTGRQVFYKYGKLSKLSEIVYD

SEQ ID NO: 843764 - protein, 1737 aa, Homo sapiens; identical to SEQ ID NO: 843760

SEQ ID NO: 843765 - protein, 804 aa, Homo sapiens
TFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNKEFKHSNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRV

SEQ ID NO: 843766 - protein, 415 aa, Homo sapiens
ARLGLGSGGGGRTVSSTLSPGLGPRGGEGGRGGGGGGGGGGGTMFLHSVNLWNLAFYVFMVFLATLGLWDVFFGFEENKCSMSYMFEYPEYQSSAVPKTWVSTDHLSIVWCKQLQLTTVRAFFDLIDADTKQITQNSKKKLSVLYHHFIRHPSKHFEENPAIISDLTGTSMWVLVKVSKWTYVAYNESEKIYFTFPLENHRKIYTHVYCQSTMLDTNSWIFACINSTSMCLQGVDLSWKAELLPTIKYLTLRLQDYPSLSHLVVYVPSVRGSKFVVDCEFFKKEKRYIQLPVTHLFSFGLSSRKVVLNTNGLYYNLELLNFGQIYQAFKINVVSKCSAVKEEITSIYRLHIPWSYEDSLTIAQAPSSTEISLKLHIAQPENNTHVALFKMYTSSDCRYEVTVKTSFSQILGQVVA

SEQ ID NO: 843767 - protein, 635 aa, Homo sapiens
ARLGLGSGGGGRTVSSTLSPGLGPRGGEGGRGGGGGGGGGGGTMFLHSVNLWNLAFYVFMVFLATLGLWDVFFGFEENKCSMSYMFEYPEYQKIELPKKLAKRYPAYELYLYGEGSYAEEHKILPLTGIPVLFLPGNAGSYKQVRSIGSIALRKAEDIDFKYHFDFFSVNFNEELVALYGGSLQKQTKFVHECIKTILKLYKGQEFAPKSVAIIGHSMGGLVARALLTLKNFKHDLINLLITQATPHVAPVMPLDRFITDFYTTVNNYWILNARHINLTTLSVAGGFRDYQVRSGLTFLPKLSHHTSALSVVSSAVPKTWVSTDHLSIVWCKQLQLTTVRAFFDLIDADTKQITQNSKKKLSVLYHHFIRHPSKHFEENPAIISDLTGTSMWVLVKVSKWTYVAYNESEKIYFTFPLENHRKIYTHVYCQSTMLDTNSWIFACINSTSMCLQGVDLSWKAELLPTIKYLTLRLQDYPSLSHLVVYVPSVRGSKFVVDCEFFKKEKRYIQLPVTHLFSFGLSSRKVVLNTNGLYYNLELLNFGQIYQAFKINVVSKCSAVKEEITSIYRLHIPWSYEDSLTIAQAPSSTEISLKLHIAQPENNTHVALFKMYTSSDCRYEVTVKTSFSQILGQVVA

SEQ ID NO: 843768 - protein, 86 aa, Homo sapiens
KLRLPPGNFGLLLPLRQQAKKGVTVLSGVIDQDCEDEISLLLHNGVDGDGQGVTASLFLALIIFLDIKSHHLFPTKKERQDHQTLQ

SEQ ID NO: 843769 - protein, 199 aa, Homo sapiens
MNLTEGPLAMAEMDPTQGRVVFEDVAIYFSQEEWGHLDEAQRLLYRDVMLENLALLSSLGSWHGAEDEEAPSQQGFSVGVSEVTTSKPCLSSQKVHPSETCGPPLKDILCLVEHNGIHPEQHIYICEAELFQHPKQQIGENLSRGDDWIPSFGKNHRVHMAEEIFTCMEGWKDLPATSCLLQHQGPQSEWKPYRDTEDR

SEQ ID NO: 843770 - protein, 120 aa, Homo sapiens
MNLTEGPLAMAEMDPTQGRVVFEDVAIYFSQEEWGHLDEAQRLLYRDVMLENLALLSSLGSWHGAEDEEAPSQQGFSVGVSEVTTSKPCLSSQKVHPSETCGPPLNSIVLNQAQNVFQGW

SEQ ID NO: 843771 - protein, 187 aa, Homo sapiens
MNLTEGRVVFEDVAIYFSQEEWGHLDEAQRLLYRDVMLENLALLSSLGSWHGAEDEEAPSQQGFSVGVSEVTTSKPCLSSQKVHPSETCGPPLKDILCLVEHNGIHPEQHIYICEAELFQHPKQQIGENLSRGDDWIPSFGKNHRVHMAEEIFTCMEGWKDLPATSCLLQHQGPQSEWKPYRDTEDR

SEQ ID NO: 843772 - protein, 70 aa, Homo sapiens
YKLLKNNKYLTDLGQKILICHYIRIQRRMKTQITSFRSLQVYKSNSNTHKTIYGLRSQESVYCCGEADTG

SEQ ID NO: 843773 - protein, 132 aa, Homo sapiens
FGVRASSSTTLGDTRQFIAVALLWFVSNYTAWLIFSLNISVLSLSFSLHLPLSEMYVNLKVQSHPLSVLVISSSSRASSMTCTCVTPTSDLPSLLVLLIHSPASLWPPPTKETFPMTTKEFPFDLFIYFSIS

SEQ ID NO: 843774 - protein, 188 aa, Homo sapiens
NERQKAIKACLDRNPEAFKPKIGKGKEGESDRRHSKGCNCKRSGCLKNYCECYEAKIMCSSICKCIGCKNFEESPERKTLMHLADAAEVRVQQQTAAKTKLSSQISDLLTRPTPALNSGGGKLPFTFVTKEVAEATCNCLLAQAEQADKKGKSKAAAERMILEEFGRCLMSVINSAGKAKSDPCAMNC

SEQ ID NO: 843775 - protein, 188 aa, Homo sapiens; identical to SEQ ID NO: 843774

SEQ ID NO: 843776 - protein, 112 aa, Homo sapiens
MSPQELVQGLGPQGLAWSLGLQGLTWQLEWLWILVLLKALSLETGLKAGSVGSGLDTEILTLAWTVEPQGQSGSMGIGLCSGATVTGFMGRSLRFRVKRLDPRVWVFVQGPQ

SEQ ID NO: 843777 - protein, 320 aa, Homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATGLQNHSFHAPERAQNELTVEDIMSCVQRFNQSVSYQRSVKMHWKLLVPVSFVVYVGLVLIVTPYRWYRYFNPGSCCLINDYLKISSIGAAWAKLKQTKPQLLHRNTNTVIP

SEQ ID NO: 843778 - protein, 209 aa, Homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEAT

SEQ ID NO: 843779 - protein, 149 aa, Homo sapiens
MQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATHMCMVMRGVQKMNSKTVTSTMLGVFREDPKTREEFLTLIRS

SEQ ID NO: 843780 - protein, 250 aa, Homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATHMCMVMRGVQKMNSKTVTSTMLGVFREDPKTREEFLTLIRS

SEQ ID NO: 843781 - protein, 232 aa, Homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATHMCMVMRGVQKMNSKKFLTLIRS

SEQ ID NO: 843782 - protein, 250 aa, Homo sapiens; identical to SEQ ID NO: 843780

SEQ ID NO: 843783 - protein, 250 aa, Homo sapiens; identical to SEQ ID NO: 843780

SEQ ID NO: 843784 - protein, 233 aa, Homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATKSNKYNKGLSPLLSSCHLFVAILK

SEQ ID NO: 843785 - protein, 250 aa, Homo sapiens; identical to SEQ ID NO: 843780

SEQ ID NO: 843786 - protein, 250 aa, Homo sapiens; identical to SEQ ID NO: 843780

SEQ ID NO: 843787 - protein, 250 aa, Homo sapiens; identical to SEQ ID NO: 843780

SEQ ID NO: 843788 - protein, 113 aa, Homo sapiens
MLCFAVAFGSFFQGYGPYPSATKMALPSQHSLQEPYTASVVRSRNLLIYEEHSPPEESSSPGSAGELGGWDRGSSLLRVSGLESRPDVDLPHFIISNETSLEKSVLLELQQHL

SEQ ID NO: 843789 - protein, 172 aa, Homo sapiens
TLLQQLQKLQTLVMGKVSRTCKLAGTQTGTCLMVVVLCFAVAFGSFFQGYGPYPSATKMALPSQHSLQEPYTASVVRSRNLLIYEEHSPPEESSSPGSAGELGGWDRGSSLLRVSGLESRPDVDLPHFIISNETSLEKSVLLELQQHLVSAKLEGNETLKVVELDRRVNTTF

SEQ ID NO: 843790 - protein, 162 aa, Homo sapiens
SELRRKREELEEAPVSSHSFDSSNVRKPLETGHRCSSSSSLPVIHDPSVFLLGPQLYLPQPQFLSPDVLMPTMAGEPNRLPGTSRSVQQFLAMCDRGETSQGAKYTGRTLNYQSLPHRSRTDNSWAPWSETNQHIGTRFLTTPGCNPQLTYTATLPERSKGL

SEQ ID NO: 843791 - protein, 133 aa, Homo sapiens
HSKSTASMTSASPGLPKEYSPCDLTVTHMYSGPQATLVSWWQNQLGLRSVPLYLRILLWPRADLNVSSVGASRILLSVVLCCDRAAVSSNAKSHTPLAPPHAQILSPSCCARGEGGGHRRCRTVFPTLFSASS

SEQ ID NO: 843792 - protein, 166 aa, Homo sapiens
LLLLRPVDVTHPDTITIQSHPDLSPSSSRVTSPFTITIKVTSPFTITIRVYLHLLHLYPHPRLPPSSPPVSSPASTSIFSTCILTRVYLHLLHLYPHPRLSPPSSPVSSSACVSIFFTCILIRVCLHLLRLYPHPRVSPSSSPVSSTACVSIFSISTAPLSTSTAM

SEQ ID NO: 843793 - protein, 218 aa, Homo sapiens
MSSSPVTNTDDMLFKDHGYPAFLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 843794 - protein, 232 aa, Homo sapiens
FLFPPPSAATNDKNNQLQAESFCKVYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 843795 - protein, 162 aa, Homo sapiens
TLTGPNRPRGLLGPHLRPQRSSEVAPASLATPSPPGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 843796 - protein, 955 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPREPARDPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTESYQSQDSSNNNPELCVLLKKPKTRRLWSRFPPWRRTAGTE

SEQ ID NO: 843797 - protein, 1098 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCEGRKASGQARQGRRLARCRSWVGEVDLRWKGCGGPSKAGNIPALVSGVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTESYQSQDSSNNNPELCVLLKKPKTRRLWSRFPPWRRTAGTE

SEQ ID NO: 843798 - protein, 1477 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPLLVKLVSDLTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRECPVLS

SEQ ID NO: 843799 - protein, 1719 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSDLTPLTVHEGDDATFRCEVSPPDADVTWLRNGAVVTPGPQETELLFLRRLQDVRAEEGQDVCLEVETGRVGAAGAVRWVRGGQPLPHDSRLSMAQDGHIHRLFIHGVILADQGTYGCESHHDRTLARLSVRRRERAYAYPRLRLQALGTRRLLQLRRCGPSDAGTYSCAVGTARAGPVRLTVRGGYGVMWRLGTALGARLAELSSPDPDDLRVLLERGRGGGVTGNCPLPRPAHAPGSAPERTVAVLSELRSVSAREGDGATFECTVSEVETTGRWELGGRPLRPGARVRIQQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGE

SEQ ID NO: 843800 - protein, 1670 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAETELLFLRRLQDVRAEEGQDVCLEVETGRVGAAGAVRWVRGGQPLPHDSRLSMAQDGHIHRLFIHGVILADQGTYGCESHHDRTLARLSVRRRERAYAYPRLRLQALGTRRLLQLRRCGPSDAGTYSCAVGTARAGPVRLTVRGGYGVMWRLGTALGARLAELSSPDPDDLRVLLERGRGGGVTGNCPLPRPAHAPGSAPERTVAVLSELRSVSAREGDGATFECTVSEVETTGRWELGGRPLRPGARVRIQQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 843801 - protein, 1751 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSDLTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRRERAYAYPRLRLQALGTRRLLQLRRCGPSDAGTYSCAVGTARAGPVRLTVRGGYGVMWRLGTALGARLAELSSPDPDDLRVLLERGRGGGVTGNCPLPRPAHAPGSAPERTVAVLSELRSVSAREGDGATFECTVSEVETTGRWELGGRPLRPGARVRIQQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 843802 - protein, 1569 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSDLTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRECPVLS

SEQ ID NO: 843803 - protein, 1864 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSDLTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRRERAYAYPRLRLQALGTRRLLQLRRCGPSDAGTYSCAVGTARAGPVRLTVRGGYGVMWRLGTALGARLAELSSPDPDDLRVLLERGRGGGVTGNCPLPRPAHAPGSAPERTVAVLSELRSVSAREGDGATFECTVSEVETTGRWELGGRPLRPGARVRIQQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEAPCGVIPLQATRRT

SEQ ID NO: 843804 - protein, 1632 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSDLTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRPRQLRVLRPLEDVTISEGGSATFQLELSQEGVTGEWARGGVRLYPGPKCHIHSDGHRHRLVLNGLGLADS

SEQ ID NO: 843805 - protein, 1114 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTGGQSLQHREEVER

SEQ ID NO: 843806 - protein, 793 aa, Homo sapiens
MDCSWHCSQELCCQWGGLRIWRVRQERPAGQAYVPLSMPTQPAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSDLTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRRERAYASPRLRLQALGTRRLLQLRRCGPSDAGTYSCAVGTARAGPVRLTVRGGYGVMWRLGTALGARLAELSSPDPDDLRVLLERGRGGGVTGNCPLPRPAHAPGSAPERTVAVLSELRSVSAREGDGATFECTVSEVETTGRWELGGRPLRPGARVRIQQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 843807 - protein, 110 aa, Homo sapiens
MTANTTLQKGIIKVRWTKDGEEVVESPALLLQKEDTVRRLVLPAVQLEDSGEYLCEIDDESASFTVTVTESYQSQDSSNNNPELCVLLKKPKTRRLWSRFPPWRRTAGTE

SEQ ID NO: 843808 - protein, 401 aa, Homo sapiens
MEQGASLQPHQTPWPPSSPPETELLFLRRLQDVRAEEGQDVCLEVETGRVGAAGAVRWVRGGQPLPHDSRLSMAQDGHIHRLFIHGVILADQGTYGCESHHDRTLARLSVRRRERAYAYPRLRLQALGTRRLLQLRRCGPSDAGTYSCAVGTARAGPVRLTVRGGYGVMWRLGTALGARLAELSSPDPDDLRVLLERGRGGGVTGNCPLPRPAHAPGSAPERTVAVLSELRSVSAREGDGATFECTVSEVETTGRWELGGRPLRPGARVRIQQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 843809 - protein, 89 aa, Homo sapiens
TPLMPGSGCPCPPDVSSWIVYPSGKVYVAAVRLERVVLTCELCRPWAEVRWTKDGEEVVESPALLLQKEDTVRRLVLPAVQLEDSGEYL

SEQ ID NO: 843810 - protein, 1051 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTESYQSQDSSNNNPELCVLLKKPKTRRLWSRFPPWRRTAGTE

SEQ ID NO: 843811 - protein, 138 aa, Homo sapiens
YSHYYVGDRDFMLPNGSREADGELVTGCGCPHPAEPPVRIIYPRDEVTLIAVTLECVVLMCELSREDAPVRWYKDGLEVEESEALVLERDGPRCRLVLPAAQPEDGGEFVCDAGDDSAFFTVTVTGGQSLQHREEVER

SEQ ID NO: 843812 - protein, 900 aa, Homo sapiens
GWEERLLRAGSQAAGRGGCGATAGEANRKDCPLSARLRARESPPPPPQSCSSGPRPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTESYQSQDSSNNNPELCVLLKKPKTRRLWSRFPPWRRTAGTE

SEQ ID NO: 843813 - protein, 532 aa, Homo sapiens
MGAGVVRNFLATEGATYICVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTESYQSQDSSNNNPELCVLLKKPKTRRLWSRFPPWRRTAGTE

SEQ ID NO: 843814 - protein, 1852 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSDLTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRRERAYAYPRLRLQALGTRRLLQLRRCGPSDAGTYSCAVGTARAGPVRLTVRGGYGVMWRLGTALGARLAELSSPDPDDLRVLLERGRGGGVTGNCPLPRPAHAPGSAPERTVAVLSELRSVSAREGDGATFECTVSEVETTGRWELGGRPLRPGARVRIQQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 843815 - protein, 1659 aa, Homo sapiens
APGLGSPLRTPPCPPTVRRCRRSAAAMKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDKVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTETTPSPLCVAPGEPVVLSCELSRAGAPVVWSHNGRPVQEGEGLELHAEGPRRVLCIQAAGPAHAGLYTCQSGAAPGAPSLSFTVQVAEPLLVKLVSDLTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRRERAYAYPRLRLQALGTRRLLQLRRCGPSDAGTYSCAVGTARAGPVRLTVRGGYGVMWRLGTALGARLAELSSPDPDDLRVLLERGRGGGVTGNCPLPRPAHAPGSAPERTVAVLSELRSVSAREGDGATFECTVSEVETTGRWELGGRPLRPGARVRIQQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 843816 - protein, 1051 aa, Homo sapiens; identical to SEQ ID NO: 843810

SEQ ID NO: 843817 - protein, 501 aa, Homo sapiens
YSHYYVGDRDFMLPNGSREADGELVTGCGCPHPAEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPLLVKLVSDLTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRECPVLS

SEQ ID NO: 843818 - protein, 420 aa, Homo sapiens
MAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRRERAYAYPRLRLQALGTRRLLQLRRCGPSDAGTYSCAVGTARAGPVRLTVRGGYGVMWRLGTALGARLAELSSPDPDDLRVLLERGRGGGVTGNCPLPRPAHAPGSAPERTVAVLSELRSVSAREGDGATFECTVSEVETTGRWELGGRPLRPGARVRIQQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 843819 - protein, 118 aa, Homo sapiens [sequence omitted]

SEQ ID NO: 843820 - protein, 632 aa, Homo sapiens [sequence omitted]

SEQ ID NO: 843821 - protein, 152 aa, Homo sapiens
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGGKARAKGQGSPREEAGRTPQNGQQKGSTKKRPHKKK

SEQ ID NO: 843822 - protein, 632 aa, Homo sapiens [sequence omitted]

SEQ ID NO: 843823 - protein, 562 aa, Homo sapiens
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGFSRRYGEDYSRSRGSPSSYNCPASDSGEEELQLQLALAMSREEAEKEVRSWQGDGSPMANGAGAVVHHQRDREPEREERKEEEKLKTSQVLGRTQRPVDPPGGLLQTPGLRSPQETVLSRSQPWDLTPMLSSSEPWGRTPVLPAGPPTTDPWALNSPHHKLPSTGADPWGASLETSDTPGGASTFDPFAKPPESTETKEGLEQALPSGKPSSPVELDLFGDPSPSSKQNGTKEPDALDLGILGEALTQPSKEARACRTPESFLGPSASSLVNLDSLVKAPQVAKTRNPFLTGLSAPSPTNPFGAGETGRPTLNQMRTGSPALGLAGGPVGAPLGSMTYSASLPLPLSSVPAGLTLPASVSVFPQAGAFAPQPLLPTPSSAGPRPPPPQTGTNPFL

SEQ ID NO: 843824 - protein, 69 aa, Homo sapiens
GMCLYCWDIEPSQVNPEGPRQHHPSEVTERQLANKRIQNMQHLKKEKRRLNKRFSRPSPIPEPGLLWSS

SEQ ID NO: 843825 - protein, 505 aa, Homo sapiens
SGAAGPARGARGQGRRVRGRSPPPFSAGSARGPGRGGSGGGGGGTARPSSDPRSASPPPGGGAHSLAARAGRQTRPVGDFLRTQAPRPRRKMQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 843826 - protein, 464 aa, Homo sapiens
RGGRASAGRPRAGAASARALAAALLGGQRARTRPRRKWRRRRRAPRPRRKMQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 843827 - protein, 416 aa, Homo sapiens
MHAHTRTHTKLSCLLVCPPEAGTCWSLRSTWSGPDVRCVYLELNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 843828 - protein, 511 aa, Homo sapiens
SGAAGPARGARGQGRRVRGRSPPPFSAGSARGPGRGGSGGGGGGTARPSSDPRSASPPPGGGAHSLAARAGRQTRPVGDFLRTQAPRPRRKMQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEGLPSALDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 843829 - protein, 273 aa, Homo sapiens
MRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 843830 - protein, 505 aa, Homo sapiens; identical to SEQ ID NO: 843825

SEQ ID NO: 843831 - protein, 405 aa, Homo sapiens
SGAAGPARGARGQGRRVRGRSPPPFSAGSARGPGRGGSGGGGGGTARPSSDPRSASPPPGGGAHSLAARAGRQTRPVGDFLRTQAPRPRRKMQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGDCQVCFIEGWKTD

SEQ ID NO: 843832 - protein, 464 aa, Homo sapiens; identical to SEQ ID NO: 843826

SEQ ID NO: 843833 - protein, 505 aa, Homo sapiens; identical to SEQ ID NO: 843825

SEQ ID NO: 843834 - protein, 295 aa, Homo sapiens
MEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 843835 - protein, 505 aa, Homo sapiens; identical to SEQ ID NO: 843825

SEQ ID NO: 843836 - protein, 243 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKTGPFPGRGGIRAVGVHRGGTIPSLCDVGQNQGVPGRGPSHAVGALKAVTLAGTSPIRWAPDPPRGPPALASAWLQALQPPYRPALLPRACSIVHT

SEQ ID NO: 843837 - protein, 198 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDKVLMK

SEQ ID NO: 843838 - protein, 806 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 843839 - protein, 105 aa, Homo sapiens
VVSEVPHSFGLTCAFPVAKDVDLEFLAKMTNGFSGADLTEICQRACKLAIRESIESEIRRERERQTNPSAMVSLHPFPRCANHGEPGSSHHHALELRVEAVGKII

SEQ ID NO: 843840 - protein, 104 aa, Homo sapiens
YLCCCFKDVDLEFLAKMTNGFSGADLTEICQRACKLAIRESIESEIRRERERQTNPSAMEVEERVCDEKLNEESFELQVSEEEEEFGLDEEDEDEDEDEEEEEG

SEQ ID NO: 843841 - protein, 108 aa, Homo sapiens
LWSPERAGPASPRPQPGPVGVDFAPCEGLRSSATEAEPGVGEGPPSSGKLTAAFLEPGRRGRRWASSVCDLSREGLLGRGRALPFASGLLTLGLLFILESLSQFSLML

SEQ ID NO: 843842 - protein, 806 aa, Homo sapiens; identical to SEQ ID NO: 843838

SEQ ID NO: 843843 - protein, 806 aa, Homo sapiens; identical to SEQ ID NO: 843838

SEQ ID NO: 843844 - protein, 806 aa, Homo sapiens; identical to SEQ ID NO: 843838

SEQ ID NO: 843845 - protein, 806 aa, Homo sapiens; identical to SEQ ID NO: 843838

SEQ ID NO: 843846 - protein, 806 aa, Homo sapiens; identical to SEQ ID NO: 843838

SEQ ID NO: 843847 - protein, 806 aa, Homo sapiens; identical to SEQ ID NO: 843838

SEQ ID NO: 843848 - protein, 863 aa, Homo sapiens
LHTTTHLRLGTRLGVANRRLSRRCRCRCHCHCHLADQEPALFARRLAAGGRKREGSRLRVCRRSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 843849 - protein, 792 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 843850 - protein, 797 aa, Homo sapiens
MPLYNRARLRILRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 843851 - protein, 683 aa, Homo sapiens
RDWVLKVVTLTWPVVFTIYNDLIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 843852 - protein, 797 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGTSVELAPVGLVGGYQLDSIMY

SEQ ID NO: 843853 - protein, 733 aa, Homo sapiens [sequence omitted]

SEQ ID NO: 843854 - protein, 520 aa, Homo sapiens
LGVYSDEGKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 843855 - protein, 585 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWLMTRSAAPPPSPMLPPRALAIESSSSKNSTQGAA

SEQ ID NO: 843856 - protein, 198 aa, Homo sapiens; identical to SEQ ID NO: 843837

SEQ ID NO: 843857 - protein, 135 aa, Homo sapiens
KGPGGVRKFRARNGSKNFWPMRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 843858 - protein, 243 aa, Homo sapiens; identical to SEQ ID NO: 843836

SEQ ID NO: 843859 - protein, 217 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKRERKVCKNGITTGAGTYSKDMESPKGL

SEQ ID NO: 843860 - protein, 118 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQQLCEVRQTIRDTVFV

SEQ ID NO: 843861 - protein, 166 aa, Homo sapiens
LEYPPLHLPVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKHGGTIWWRKLWSRRQWRKWGLWWEEPILSFFLFAMGFTV

SEQ ID NO: 843862 - protein, 92 aa, Homo sapiens
GSRVKLHFILDFLMELVRLRMEPDLTEICQRACKLAIRESIESEIRRERERQTNPSAMVSLHPFPRCANHGEPGSSHHHALELRVEAVGKII

SEQ ID NO: 843863 - protein, 806 aa, Homo sapiens; identical to SEQ ID NO: 843838

SEQ ID NO: 843864 - protein, 806 aa, Homo sapiens; identical to SEQ ID NO: 843838

SEQ ID NO: 843865 - protein, 806 aa, Homo sapiens; identical to SEQ ID NO: 843838

SEQ ID NO: 843866 - protein, 806 aa, Homo sapiens; identical to SEQ ID NO: 843838

SEQ ID NO: 843867 - protein, 806 aa, Homo sapiens; identical to SEQ ID NO: 843838

SEQ ID NO: 843868 - protein, 806 aa, Homo sapiens; identical to SEQ ID NO: 843838

SEQ ID NO: 843869 - protein, 770 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 843870 - protein, 762 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 843871 - protein, 925 aa, Homo sapiens
THHHPLTARYEAGCCEPSFESSLPLPLPLPLPPRGSGASVVRPTPRCRWEEARGKPLAGLSPLLAHRLEEPSPGPVGRLPPLVAVTRGPPQPPAGRGARHGFWSRVSVRAPFAAAAARTGTSRAGSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 843872 - protein, 806 aa, Homo sapiens; identical to SEQ ID NO: 843838

SEQ ID NO: 843873 - protein, 733 aa, Homo sapiens [sequence omitted]

SEQ ID NO: 843874 - protein, 728 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIENHFEEAMRFARRSVSDNDIRNICT

SEQ ID NO: 843875 - protein, 639 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGRINDVRPVGSANDEHIFFLWTCHPFLVGC

SEQ ID NO: 843876 - protein, 513 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRGHEQINHQNAGTGVSARYLGDSGAEESGEQAAFCGPESEWDAWGNCRFVAALGGVGQMPV

SEQ ID NO: 843877 - protein, 168 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGLLAGGRRGASRGHDLTLLC

SEQ ID NO: 843878 - protein, 128 aa, Homo sapiens
GRTTARYEAWVVASVLPASGRRAGAALGSVGWAADVMWPVFWTVVRTYAPYVTFPVAFVVGAVGYHLEWFIRGKDPQPVEEEKSISERREDRKLDELLGKDHTQVVSLKDKLEFAPKAVLNRNRPEKN

SEQ ID NO: 843879 - protein, 187 aa, Homo sapiens
MVLLWVVTCPATMLTEPQNPHLIGFVAYSGPSHTTQPHKYWLLLDGQADPAAAEGPVKRKAASVVWWPQALRHLSLLVHCWEESYEMNIGCQSLWAGGLASSGNGWDLGVAFRRDTCMSSSSLHWKEFKYAPGSLHYFALSFVLILTEICLVSSGMGFPQEGKHFSVLGSPDCSLWGRDEHVPREFA

SEQ ID NO: 843880 - protein, 187 aa, Homo sapiens; identical to SEQ ID NO: 843879

SEQ ID NO: 843881 - protein, 187 aa, Homo sapiens; identical to SEQ ID NO: 843879

SEQ ID NO: 843882 - protein, 160 aa, Homo sapiens
MEDTGPYGPTVGGDLSCYHVDRAPEPTSNWLCCLFWPFPHPQALRHLSLLVHCWEESYEMNIGCQSLWAGGLASSGNGWDLGVAFRRDTCMSSSSLHWKEFKYAPGSLHYFALSFVLILTEICLVSSGMGFPQEGKHFSVLGSPDCSLWGRDEHVPREFA

SEQ ID NO: 843883 - protein, 187 aa, Homo sapiens; identical to SEQ ID NO: 843879

SEQ ID NO: 843884 - protein, 187 aa, Homo sapiens; identical to SEQ ID NO: 843879

SEQ ID NO: 843885 - protein, 187 aa, Homo sapiens; identical to SEQ ID NO: 843879

SEQ ID NO: 843886 - protein, 187 aa, Homo sapiens; identical to SEQ ID NO: 843879

SEQ ID NO: 843887 - protein, 117 aa, Homo sapiens [sequence omitted]

SEQ ID NO: 843888 - protein, 113 aa, Homo sapiens
KKRRNNGRAKKGRGHVQPIRCTNCARCVPKDNAIKKFVIRNIVEAAAVRDISEASVFDAYVLPKLYVKLHYCVSCAIHSKVVRNRSREARKDRTPPPRFRPAGAAPRPPPKPM

SEQ ID NO: 843889 - protein, 144 aa, Homo sapiens
VQPAGSKTQRSLKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVK

SEQ ID NO: 843890 - protein, 117 aa, Homo sapiens
MYMIMSLIMRRPPVQGPGENKNREVTMSSYLLELGHILPLLSLDNNSRLPSLQTPGLLPSPPPFLASQAFGLELRATPSDSLILRPSGLELSHTTSLPGSPVCRRPVLGLLANFPNK

SEQ ID NO: 843891 - protein, 92 aa, Homo sapiens
DKFEHLKMIQQEEIRKLEEEKKKLEGEIIDFYKMKAASEALQTQLSTDTKKDKHPDPYEFLLLRKIKHPGFNEELTITLLIIQKHVAGLSHF

SEQ ID NO: 843892 - protein, 92 aa, Homo sapiens; identical to SEQ ID NO: 843891

SEQ ID NO: 843893 - protein, 92 aa, Homo sapiens; identical to SEQ ID NO: 843891

SEQ ID NO: 843894 - protein, 129 aa, Homo sapiens
MSQGVRRAGAGQGVAAAVQLLVTLSFLRSVVEAQVTGVLDDCLCDIDSIDNFNTYKIFPKIKKLQERDYFRYYKVNLKRPCPFWAEDGHCSIKDCHVEPCPESKIPGMLGILISTWEQLTGHVIKAAFI

SEQ ID NO: 843895 - protein, 467 aa, Homo sapiens [sequence omitted]

SEQ ID NO: 843896 - protein, 467 aa, Homo sapiens [sequence omitted]

SEQ ID NO: 843897 - protein, 448 aa, Homo sapiens [sequence omitted]

SEQ ID NO: 843898 - protein, 176 aa, Homo sapiens
MSQGVRRAGAGQGVAAAVQLLVTLSFLRSVVEAQVTGVLDDCLCDIDSIDNFNTYKIFPKIKKLQERDYFRYYKVNLKRPCPFWAEDGHCSIKDCHVEPCPESKIPVGIKAGHSNKYLKMANNTKELEVCEQANKLGAINSTLSNQSKEAFIDWARYDDSRDHFCELDGNTINYYN

SEQ ID NO: 843899 - protein, 116 aa, Homo sapiens
MSQGVRRAGAGQGVAAAVQLLVTLSFLRSVVEAQVTGVLDDCLCDIDSIDNFNTYKIFPKIKKLQERDYFRYYKVNLKRPCPFWAEDGHCSIKDCHVEPCPESKIPVGIKAGHSNK

SEQ ID NO: 843900 - protein, 467 aa, Homo sapiens [sequence omitted]

SEQ ID NO: 843901 - protein, 348 aa, Homo sapiens
MANNTKELEVCEQANKLGAINSTLSNQSKEAFIDWARYDDSRDHFCELDDERSPAAQYVDLLLNPERYTGYKGTSAWRVWNSIYEENCFKPRSVYRPLNPLAPSRGEDDGESFYTWLEGLCLEKRVFYKLISGLHASINLHLCANYLLEETWGKPSWGPNIKEFKHRFDPVETKGEGPRRLKNLYFLYLIELRALSKVAPYFERSIVDLYTGNAEEDADTKTLLLNIFQDTKSFPMHFDEKSMFAGDKKGAKSLKEEFRLHFKNISRIMDCVGCDKCRLWGKLQTQGLGTALKILFSEKEIQKLPENSPSKGFQLTRQEIVALLNAFGRLSTSIRDLQNFKVLLQQSR

SEQ ID NO: 843902 - protein, 467 aa, Homo sapiens [sequence omitted]

SEQ ID NO: 843903 - protein, 467 aa, Homo sapiens [sequence omitted]

SEQ ID NO: 843904 - protein, 276 aa, Homo sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVCPELWDTSWWLSGIQVATVLPGSLCCPLLRPWLLDASAYVCLLALFSWVL

SEQ ID NO: 843905 - protein, 213 aa, Homo sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGCVQPCRPRGGREEGAWARGLCSQPGAAADPENSQLLFLF

SEQ ID NO: 843906 - protein, 118 aa, Homo sapiens
GVCALQRLLPGSHSQMCEGDPARPGSASAGVMLPRASRHLLLGGPGTRRCAVQVSAASGAGRARAALAWVNISEAHSRWPLTTEFCQPNKDEDLSESSVSPPTVTHLRTCLVTVQGGP

SEQ ID NO: 843907 - protein, 148 aa, Homo sapiens
MKAEYLEPLSSLHQEGLHLHLWAKLLNEPPGTDLLTALCQASQCFHSYLPFGTSWAACPRSESRNVLTESARIARGKITDLANLQIFAPDVPQMHVIDHTKGQPSEGESRNVLTESARIARGKITDLANLSIFAPDVPQMHVIDHTCG

SEQ ID NO: 843908 - protein, 268 aa, Homo sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 843909 - protein, 388 aa, Homo sapiens
CAGAVPTSNAFVEGWVRTLCPCVTFRPRCPHRNGGCEGPGGLEARCGICIHVPVPRRSDAFPARSPSPLRAAPRGQGRAGEWTEGVRSAPASRDQPSLFSAQGRPLFLGPLPPPHVGSFTPSQLLRPRSAPFSRVSARGPGRPLSPQSTPAAQVGPFPPGQLPLLSQVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 843910 - protein, 247 aa, Homo sapiens
MMYSRRRVYFGRAFAFRSVPRGTFALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 843911 - protein, 275 aa, Homo sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMEEREIAAPQPPGLTSGE

SEQ ID NO: 843912 - protein, 371 aa, Homo sapiens
CAGAVPTSNAFVEGWVRTLCPCVTFRPRCPHRNGGCEGPGGLEARCGICIHVPVPRRSDAFPARSPSPLRAAPRGQGRAGEWTEGVRSAPASRDQPSLFSAQGRPLFLGPLPPPHVGSFTPSQLLRPRSAPFSRVSARGPGRPLSPQSTPAAQVGPFPPGQLPLLSQVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGHSLKDLPGHCPGRPLKWSLRKRCRLRAPEGGPCCSRVTAGVKVSPMVSTSGSRPCQRSVPWMSAQREEPMALSSVTD

SEQ ID NO: 843913 - protein, 197 aa, Homo sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLCVFELQGLPLSMWSRWEGGAPVCCPMWSVERRWEGVVIGAVSGFRVWAGHVPAL

SEQ ID NO: 843914 - protein, 268 aa, Homo sapiens; identical to SEQ ID NO: 843908

SEQ ID NO: 843915 - protein, 217 aa, Homo sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGCDASTSLPAPAPWWSWNAALCCPGLSCVWCWQGESRTCVGEHQ

SEQ ID NO: 843916 - protein, 244 aa, Homo sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLLCCIAPVLAAKVLRGVEVTVGHEQEEGGKWPYAGTAEAIKALGAKHCVKEVVEAHVDQKNKVVTTPAFMCETALHYIHDGIGAMEEREIAAPQPPGLTSGE

SEQ ID NO: 843917 - protein, 268 aa, Homo sapiens; identical to SEQ ID NO: 843908

SEQ ID NO: 843918 - protein, 182 aa, Homo sapiens
MHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 843919 - protein, 275 aa, Homo sapiens
CAGAVPTSNAFVEGWVRTLCPCVTFRPRCPHRNGGCEGPGGLEARCGICIHVPVPRRSDAFPARSPSPLRAAPRGQGRAGAVWMRSLRWDRDPRGLGEVLRGSWSSTPGANVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 843920 - protein, 237 aa, Homo sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 843921 - protein, 135 aa, Homo sapiens
SEEAFLSPGRSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 843922 - protein, 69 aa, Homo sapiens
IGARVLGGVEAWPVVTCMVLGRLRSVAGRPQLCHLLPCCLLPCPMRTGSFTASSSSEKRRCCHCLPWWL

SEQ ID NO: 843923 - protein, 268 aa, Homo sapiens; identical to SEQ ID NO: 843908

SEQ ID NO: 843924 - protein, 251 aa, Homo sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGHSLKDLPGHCPGRPLKWSLRKRCRLRAPEGGPCCSRVTAGVKVSPMVSTSGSRPCQRSVPWMSAQREEPMALSSVTD

SEQ ID NO: 843925 - protein, 275 aa, Homo sapiens; identical to SEQ ID NO: 843919

SEQ ID NO: 843926 - protein, 2548 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVQIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSEWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQRETSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 843927 - protein, 2620 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVQIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSEWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQREQVARPAHKKKARMARTRSDFLTRGTFADGEGDTEEDDYDDIIEPLLSLDQASHCELGPAPSLGQASHSDSEMTSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 843928 - protein, 2620 aa, Homo sapiens; identical to SEQ ID NO: 843927

SEQ ID NO: 843929 - protein, 2580 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVQIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSEWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQREQVARPAHKKKARMARTRSDFLTRGTFADGEGDTEEDDYDDIIEPLLSLDQASHCELGPAPSLGQASHSDSEMTSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 843930 - protein, 2620 aa, Homo sapiens; identical to SEQ ID NO: 843927

SEQ ID NO: 843931 - protein, 2562 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVQIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSEWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQREQVARPAHKKKARMARTRSDFLTRGTFADGEGDTEEDDYDDIIEPLLSLDQASHCELGPAPSLGQASHSDSEMTSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 843932 - protein, 275 aa, Homo sapiens
MNFSLQGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 843933 - protein, 795 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSKATNPDKLLSHIHLEMETRSILHQGGI

SEQ ID NO: 843934 - protein, 2368 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVQIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSEWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQREQVARPAHKKKARMARTRSDFLTRGTFADGEGDTEEDDYDDIIEPLLSLDQASHCELGPAPSLGQASHSDSEMTSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMVRCNTWNSGKMGVVLGI

SEQ ID NO: 843935 - protein, 376 aa, Homo sapiens [sequence omitted]

SEQ ID NO: 843936 - protein, 103 aa, Homo sapiens
RELCHAESAACLGHKHVACLLQLGGESQRKGLRGMQRWRGPHNMEQRQLCITLLMEKPRITAHVFCDLGLWRNRRMSILPATPSPVGSTSLPPNLPGHLEFRY

SEQ ID NO: 843937 - protein, 139 aa, Homo sapiens [sequence omitted]

SEQ ID NO: 843938 - protein, 131 aa, Homo sapiens
YSTAPKKKCIQIKDLILLGRINPGNNILEFKTQETTHKASILLNGKLKVESGQIYKNPVTWLKDLLGGNSYVTWNYAWSKVTYLGKELLRYVSEDAPILPEPNSVPQQYQPCLPEVACLDDPVQEPKQINV

SEQ ID NO: 843939 - protein, 131 aa, Homo sapiens; identical to SEQ ID NO: 843938

SEQ ID NO: 843940 - protein, 131 aa, Homo sapiens; identical to SEQ ID NO: 843938

SEQ ID NO: 843941 - protein, 128 aa, Homo sapiens
KTLSLVLWRCGFWSGVAVWSAISQVLMSNTEVTSPGTGRATPLTHKSHVQSHVMDVVGGFIPNHQYPAPWLPQVQPLRGCFTRSPHSCEHCRMSHCETTNSLALVKMTKVIGKLVTGNLPVLCICSSL

SEQ ID NO: 843942 - protein, 520 aa, Homo sapiens
MSIPLKSSFLLSYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 843943 - protein, 260 aa, Homo sapiens
MGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 843944 - protein, 267 aa, Homo sapiens
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKEVGKRHRPNPGLLILISSHVTTPSRRELRFWDLAPTVSEWSRLMREGKWSPRIWRGRLVWPRLRVLCRSWSVPPLAPLC

SEQ ID NO: 843945 - protein, 301 aa, Homo sapiens
MSIPLKSSFLLSYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDG

SEQ ID NO: 843946 - protein, 301 aa, Homo sapiens
VEQARTTSYGRSCLHTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDG

SEQ ID NO: 843947 - protein, 115 aa, Homo sapiens
PLPGSAARLAGAASERVSLGTHGEVQLGEWAAPCAEGMEEGALRPARAPWPGRAPAAIETEGRTLGPSMIVRWVLDGRRVCWVSWFRLLEKSSSLFLPRGRPAHRSEPAPQVEPE

SEQ ID NO: 843948 - protein, 326 aa, Homo sapiens
MSIPLKSSFLLSYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKEVGKRHRPNPGLLILISSQLSRDLPGLLPALPTSSKASLPPGGCASFQSRRSSNCSCSHCLLFGGRGGAVSAVDTVHTLPTQECGLWTSSIGMTWGLLEMQNLAGHGDSRL

SEQ ID NO: 843949 - protein, 380 aa, Homo sapiens
LGTHGEVQLGWLTPVVPARWEAERGNDSALPQILMADSEALPSLAGDPVAVEALLRAVFGVVVDEAIQKGTSVSQKCHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 843950 - protein, 493 aa, Homo sapiens
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 843951 - protein, 446 aa, Homo sapiens
MSIPLKSSFLLSYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTKPCHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 843952 - protein, 301 aa, Homo sapiens; identical to SEQ ID NO: 843945

SEQ ID NO: 843953 - protein, 264 aa, Homo sapiens
MSIPLKSSFLLSYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEVSQ

SEQ ID NO: 843954 - protein, 174 aa, Homo sapiens
GGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHW

SEQ ID NO: 843955 - protein, 253 aa, Homo sapiens
GGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSK

SEQ ID NO: 843956 - protein, 181 aa, Homo sapiens
GGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCLPSCSCG

SEQ ID NO: 843957 - protein, 119 aa, Homo sapiens
MVSHCGILRRSSCLSAASPGPAPPASQWPLSAQPSSCLPAAFPSPAFDFRWPLQASTRPSLLPPEGLHRPSLCLTADSPRPASCCFTAASRVQSSCLSAASAGPAPACQWPLQAHGAHS

SEQ ID NO: 843958 - protein, 144 aa, Homo sapiens
VGLKSCERLRGLQTQAGAEPKELVGWEVEMQPGGTAPVSLYSPNVCLTADSSGPASASLWTPQAKLPTFQQLLHTHSRLPVASSGPWGSFLTTAFPGPVFPFRRPLRAQNLLKSASPDPLAPSGHSLRAQLFFLVGSPGPIPAS

SEQ ID NO: 843959 - protein, 137 aa, Homo sapiens
VGLKSCERLRGLQTQAGAEPKELVGWEVEMQPGGTAPVSLYSPNVCLTADSSGPASASLWTPQAKLPTFQQLLHTQLLPPSGLFRPSSCFTRAFPGPTFVSWQPSLARFLPVSQQPRQAQVLPHTGLSTSSLCLTVA

SEQ ID NO: 843960 - protein, 77 aa, Homo sapiens
RAWRMFATLSSLAWVLFTSPLEILLSLDLDRKWGIVFPQRQAVNLLVKCLFKKQVKIIASQLEVLPRYDLQEGPEDK

SEQ ID NO: 843961 - protein, 582 aa, Homo sapiens
MSESWQQPPQTQPQQPQPPQPQHHAEPPPALAEHTLPPGTAENPLGCAVYGILLQPDPGLQPPQHAPLQAAGEPGPKCGVCGHDLAHLSSPHEHQCLAGHDRSFQCTQCLKIFHQATDLLEHQCVQAEQKPFVCGVCKMGFSLLTSLAQHHSSHSGLVKCSICEKTYKPAEAAEPATTAAPSLPAAPAPSTVTPAEQADKPYSCPICQKPFKHLSELSRHERIHTGEKPYKCTLCDKSFSQSSHLVHHKRTHSSERPYKCAVCEKTFKHRSHLVRHMYAHSGEHHLFRCNVCELHFKESSELLQHPCTPSGERPFRCGECQKAFKRPSDLRQHERTHSAERPFKCDLCPMGFKQQYALMRHRRTHKTEEPFKCGLCEKGFGQPSHLLYHQHVHTLETLFKCPVCQKGFDQSAELLRHKCLPGAAERPFKCPVCNKAYKRASALQKHQLAHCAAAEKPLRCTLCERRFFSSSEFVQHRCDPAREKPLKCPDCEKRFKYASDLQRHRRVHTGEKPYKCPNCDKAFKQREHLNKHQGVHAREQQFKCVWCGERFLDVALLQEHSAQHSAAAAAAEGAYQVAACLP

SEQ ID NO: 843962 - protein, 582 aa, Homo sapiens; identical to SEQ ID NO: 843961

SEQ ID NO: 843963 - protein, 640 aa, Homo sapiens
MSERKEGRGKGKGKKKERGSGKKPESAAGSQSPALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 843964 - protein, 640 aa, Homo sapiens; identical to SEQ ID NO: 843963

SEQ ID NO: 843965 - protein, 645 aa, Homo sapiens
MSERKEGRGKGKGKKKERGSGKKPESAAGSQSPALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 843966 - protein, 462 aa, Homo sapiens
MSERKEGRGKGKGKKKERGSGKKPESAAGSQSPALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 843967 - protein, 241 aa, Homo sapiens
MSERKEGRGKGKGKKKERGSGKKPESAAGSQSPALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 843968 - protein, 247 aa, Homo sapiens
MSERKEGRGKGKGKKKERGSGKKPESAAGSQSPALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESAQMSLLVIAAKTT

SEQ ID NO: 843969 - protein, 703 aa, Homo sapiens
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCQPGFTGARCTENVPMKVQNQEKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 843970 - protein, 439 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSATSTSTTGTSHLVKCAEKEKTFCVNGGECFMVKDLSNPSRYLCKCPNEFTGDRCQNYVMASFYSTSTPFLSLPE

SEQ ID NO: 843971 - protein, 161 aa, Homo sapiens
KPDPSPWTKLACAESRPRRALRLRRDVRAQRRQRQREGQEEGARLRQEAGVRGGQPEPRWVRSAARAPRSSSCSSYSSSSSDAVASPSPSPSPVLFALRSERPLSRAVLPLLGAAAHLGAESYRAPTPRAQGKGQQSRPHPPRVPGALRSLARPLPSALAA

SEQ ID NO: 843972 - protein, 241 aa, Homo sapiens; identical to SEQ ID NO: 843967

SEQ ID NO: 843973 - protein, 296 aa, Homo sapiens
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYSTSTPFLSLPE

SEQ ID NO: 843974 - protein, 422 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPQLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 843975 - protein, 211 aa, Homo sapiens
MSERKEGRGKGKGKKKERGSGKKPESAAGSQSPALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCK

SEQ ID NO: 843976 - protein, 645 aa, Homo sapiens; identical to SEQ ID NO: 843965

SEQ ID NO: 843977 - protein, 236 aa, Homo sapiens
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLCAQMSLLVIAAKTT

SEQ ID NO: 843978 - protein, 512 aa, Homo sapiens
MSYHLFFSEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 843979 - protein, 116 aa, Homo sapiens
ALRIYRLEWWRQVLEGSFSPGERNRKGGLKSLRLNTHTHTHTPPTHTHHTHTHTHTHTHTHTHTSSGPSCDSLQPQASLLTSLCFLVYSYEMGISSTCCIYVTGMKFTWKRGQSII

SEQ ID NO: 843980 - protein, 166 aa, Homo sapiens
MTPVQRGGPGALVALGWGTAVASAEGFSPGAPGGKRRAFFGSGIRGRGRGRGRGRGRGRGARGGKAEDKEWMPVTKLGRLVKDMKIKSLEEIYLFSLPIKESEIIDFFLFFPPFGGAGGGGPPFSFRAKGGICRFLEDYASAEADPCRPAHQVQGIVCLKFRGRNL

SEQ ID NO: 843981 - protein, 292 aa, Homo sapiens
MTPVQRGGPGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVAGLGVKCSKEVATAICGAIILAKLSIVPVRRGYWGNKIGKPHTVPCKVTGRCGSVLVRLIPAPRGTGIVSAPVPKKLLMMAGIDDCYTSARGCTATLGNFAKATFDAIFKTYSYLTPDLWKETVFTKSPYQEFTDHLVKTHTRVSVQRTQAPAVATT

SEQ ID NO: 843982 - protein, 82 aa, Homo sapiens
KDYKTSESQLATNPPPAPSTTSWRHWKMLLLFSDHRLPPKPILPAALPEKLNPRDRKDHLHSLYWAFPSANVWHERGCIPLP

SEQ ID NO: 843983 - protein, 121 aa, Homo sapiens
MKGTQLTPGTRPNFPMAGSQQWHSSLTQAFCQQPEDHSTPPIMTLHHCGGLSASFPSPALPGFDLAEKQCRIQVTRGFHNQTHYLKHSETPEYFSQGTEVRDNTLPVPPQLPHACKYHLTG

SEQ ID NO: 843984 - protein, 85 aa, Homo sapiens
PGIRDTALLLSSGCGCSFSISLAALHPSFLNAAPPSLPWAFWSRSPSGPHPGRAHLFSGFDYHMLLGPSHRASALMSAQKSSDPQ

SEQ ID NO: 843985 - protein, 97 aa, Homo sapiens
MEDIVILTLLDAAPEGGGRGRALGATILAGEAARGSLLWMQQGLLKNSQSRDFQAHMHLASSSHLLFLSVSNVPLPSLPGSSAEKSEEEPCDPKHVL

SEQ ID NO: 843986 - protein, 291 aa, Homo sapiens
AECACALVELVAALRRGSAVFRAAGAAMAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHRHNPWIRDSSGYILYPSGTRGTSLCRIPLPVQRHACLSRFGSHRDSPLAPAPLTY

SEQ ID NO: 843987 - protein, 561 aa, Homo sapiens
AECACALVELVAALRRGSAVFRAAGAAMAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 843988 - protein, 509 aa, Homo sapiens
AECACALVELVAALRRGSAVFRAAGAAMAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEL

SEQ ID NO: 843989 - protein, 528 aa, Homo sapiens
MDAQQTKTNEARLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 843990 - protein, 445 aa, Homo sapiens
MEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 843991 - protein, 528 aa, Homo sapiens; identical to SEQ ID NO: 843989

SEQ ID NO: 843992 - protein, 392 aa, Homo sapiens
AECACALVELVAALRRGSAVFRAAGAAMAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQIPSLWISSVLKGLWGQEVQESTCSREIRICWRIRAIFTWKRFRESKERGCAGENWANVWHVRASL

SEQ ID NO: 843993 - protein, 472 aa, Homo sapiens
SGVRLRACGAGGGAPQGLGCFPRGRRGHGAAGKAAQGAEVRPAAESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 843994 - protein, 588 aa, Homo sapiens
AECACALVELVAALRRGSAVFRAAGAAMAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFHFLEFLVYIKSLKSSFSLYVLGIRPFVSLYHCAKYFSYDHNPWSMTVVIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 843995 - protein, 261 aa, Homo sapiens
MTSYSINKLFNTPTPAPLRLVLISAIKTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 843996 - protein, 119 aa, Homo sapiens
MDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 843997 - protein, 561 aa, Homo sapiens; identical to SEQ ID NO: 843987

SEQ ID NO: 843998 - protein, 561 aa, Homo sapiens; identical to SEQ ID NO: 843987

SEQ ID NO: 843999 - protein, 573 aa, Homo sapiens
AECACALVELVAALRRGSAVFRAAGAAMAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHELLIKIHVSVVSFSCRYGAAEPHTIAAFLGGAAAQEVIKIITKQFVIFNNTYIYSGMSQTSATFQL

SEQ ID NO: 844000 - protein, 426 aa, Homo sapiens
AECACALVELVAALRRGSAVFRAAGAAMAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEYRTFTTLQLFRFLRVVRVTLPC

SEQ ID NO: 844001 - protein, 445 aa, Homo sapiens; identical to SEQ ID NO: 843990

SEQ ID NO: 844002 - protein, 445 aa, Homo sapiens; identical to SEQ ID NO: 843990

SEQ ID NO: 844003 - protein, 419 aa, Homo sapiens
RAGFRPTRRGSPQFLLLESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 844004 - protein, 373 aa, Homo sapiens
AECACALVELVAALRRGSAVFRAAGAAMAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILRKCTLGLQKMTADSAPPLLSHVNTATNIHLQIPSRSEDILADDRCINLPNRLHHFGFELVPSGLCGREGSGTFPVRANPVDAFRPFRRPGSGTP

SEQ ID NO: 844005 - protein, 228 aa, Homo sapiens
AECACALVELVAALRRGSAVFRAAGAAMAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDVLFQMIAHVPSTSSSRHLF

SEQ ID NO: 844006 - protein, 404 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHG

SEQ ID NO: 844007 - protein, 72 aa, Homo sapiens
DIVDHLLWVVVVVLQAGQDEAPTLSQLDRNLREMKPDPTPLLTSRHNVFQNDEFDVFSRDSVDLSRVHKGKR

SEQ ID NO: 844008 - protein, 870 aa, Homo sapiens
GPGRDFLSAPAESQFDPGSAGAQGAVTVVGGGGGGGGTEPVVEPPRPPRVCRDHVCLICWDPRAGTGGSRSTMPALPLDQLQITHKDPKTGKLRTSPALICTCNSMIQIGFKWEGVLQTHMRGGLEESLWYPRLYSLETRHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844009 - protein, 755 aa, Homo sapiens
GQAETSCLLLRNRSLTPEVRALRELSPWSAAAAAAAAQSRWWSRRGGSRSTMPALPLDQLQITHKDPKTGKLRTSPALVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844010 - protein, 643 aa, Homo sapiens
MQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844011 - protein, 521 aa, Homo sapiens
MPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844012 - protein, 827 aa, Homo sapiens
GPGRDFLSAPAESQFDPGSAGAQGAVTVVGGGGGGGGTEPVVEPPRPPRVCRDHVCLICWDPRAGTGGSRSTMPALPLDQLQITHKDPKTGKLRTSPALICTCNSMIQIGFKWEGVLQTHMRGGLEESLWYPRLYSLETRHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPEMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844013 - protein, 808 aa, Homo sapiens
GQAETSCLLLRNRSLTPEVRALRELSPWSAAAAAAAAQSRWWSRRGGSRSTMPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844014 - protein, 305 aa, Homo sapiens [sequence omitted]

SEQ ID NO: 844015 - protein, 837 aa, Homo sapiens
GQAETSCLLLRNRSLTPEVRALRELSPWSAAAAAAAAQSRWWSRRGGSRSTMPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVGHQGQVSAGPGKPGQPLSPPDPCFMPLQVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844016 - protein, 262 aa, Homo sapiens
HPETEEEECGLDSLISCACLEYYHYDPEEMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844017 - protein, 109 aa, Homo sapiens
GPGRDFLSAPAESQFDPGSAGAQGAVTVVGGGGGGGGTEPVVEPPRPPRVCRDHVCLICWDPRAGTGGSRSTMPALPLDQLQITHKDPKTGKLRTSPALICTCNSMIQI

SEQ ID NO: 844018 - protein, 95 aa, Homo sapiens
GPGRDFLSAPAESQFDPGSAGAQGAVTVVGGGGGGGGTEPVVEPPRRVTQHNASSAPGPTPDHPQGPEDRKAEDFTSAAPRAEGRPVFCVIQTAP

SEQ ID NO: 844019 - protein, 388 aa, Homo sapiens
GQAETSCLLLRNRSLTPEVRALRELSPWSAAAAAAAAQSRWWSRRGGSRSTMPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMQIWFRMMWKISISFFLE

SEQ ID NO: 844020 - protein, 70 aa, Homo sapiens
GPGRDFLSAPAESQFDPGSAGAQGAVTVVGGGGGGGGTEPVVEPPRPPRVCRDHVCLICWDPRAGTGVKD

SEQ ID NO: 844021 - protein, 109 aa, Homo sapiens; identical to SEQ ID NO: 844017

SEQ ID NO: 844022 - protein, 307 aa, Homo sapiens
GPGRDFLSAPAESQFDPGSAGAQGAVTVVGGGGGGGGTEPVVEPPRPPRVCRDHVCLICWDPRAGTGGSRSTMPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQLQQYPSALVVGRGGGKTTPEWGRAVAPEMPPE

SEQ ID NO: 844023 - protein, 808 aa, Homo sapiens; identical to SEQ ID NO: 844013

SEQ ID NO: 844024 - protein, 757 aa, Homo sapiens
MPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844025 - protein, 776 aa, Homo sapiens
GPGRDFLSAPAESQFDPRKCGRSGSCHRGRRRRRRRRHRAGGGAAEHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844026 - protein, 789 aa, Homo sapiens
EIYQKSSGEVFLLQLRTALCKKSHFGWVSRCMNQVLNHNRSLLRREVEASLLTLGSAPEQALPPGVCVSALFFPSIFLSGGSRSTMPALPLDQLQITHKDPKTGKLRTSPALVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844027 - protein, 783 aa, Homo sapiens
GQAETSCLLLRNRSLTPEVRALRELSPWSAAAAAAAAQSRWWSRRGGSRSTMPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844028 - protein, 502 aa, Homo sapiens
ARYPNDGPQLLGCQTFQKHDFVTLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844029 - protein, 837 aa, Homo sapiens; identical to SEQ ID NO: 844015

SEQ ID NO: 844030 - protein, 233 aa, Homo sapiens [sequence omitted]

SEQ ID NO: 844031 - protein, 233 aa, Homo sapiens
LFQASMALCSSSGGQGADKEVLQAGEKPGPLLQSRKPDCTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844032 - protein, 154 aa, Homo sapiens
GNHELYMRRRKPDTIEVQQMKAQAREEKASEAAGAATAGNREEKERTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 844033 - protein, 309 aa, Homo sapiens
GQAETSCLLLRNRSLTPEVRALRELSPWSAAAAAAAAQSRWWSRRGGSRSTMPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLDKDTRHECSGTRARIVYV

SEQ ID NO: 844034 - protein, 109 aa, Homo sapiens; identical to SEQ ID NO: 844017

SEQ ID NO: 844035 - protein, 71 aa, Homo sapiens
GPGRDFLSAPAESQFDPGSAGAQGAVTVVGGGGGGGGTEPVVEPPRPPRVCRDHVCLICWDPRAGTGQVIL

SEQ ID NO: 844036 - protein, 144 aa, Homo sapiens
MICCSALSPRIYFSFHRRWPDWHCISKLITRHRTTRHVLRCSPLPLCPINRSCICHHRRLHSLISPILRLHPRPNLRQNPFRYHIHRRKSNFLPTTLSRPIRNAPTLLGLSRCIHHMKYPIICRLIHFSNSSNINNFHVVYASG

SEQ ID NO: 844037 - protein, 140 aa, Homo sapiens
MIPTCTGVHTCTGSIIHNLNNEQDIRKIGGLLKTIPLTSTSLTIGSLALAGIPFLTGFYSKDHIIETSKHIIHKRLSPYHIHRRKSNFLPTTLSRPIRNAPTLLGLSRCIHHMKYPIICRLIHFSNSSNINNFHVVYASG

SEQ ID NO: 844038 - protein, 431 aa, Homo sapiens
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDLHVNPKKQTIGNSCKACGYRGMLDTHHKLCTFILKNPPENSDSGTGKKEKEKKNRKGKDKENGSVSSSETPPPPPPPNEINPPPHTMEEEEDDDWGEDTTEEAQRRRMDEISDHAKVLTLSDDLERTIEERVNILFDFVKKKKEEGVIDSSDKEIVAEAERLDVKAMGPLVLTEVLFNEKIREQIKKYRRHFLRFCHNNKKAQRYLLHGLECVVAMHQAQLISKIPHILKEMYDADLLEEEVIISWSEKASKKYVSKELAKEIRVKAEPFIKWLKEAEEESSGGEEEDEDENIEVVYSKAASVPKVETVKSDNKDDDIDIDAI

SEQ ID NO: 844039 - protein, 71 aa, Homo sapiens
MSVNVNRSVSDQFYRYKMPRLIAKVEGKGNGIKTVIVNMVDVAKALNRPPTCKKSLEKSTGHIMDRVFKVF

SEQ ID NO: 844040 - protein, 431 aa, Homo sapiens; identical to SEQ ID NO: 844038

SEQ ID NO: 844041 - protein, 431 aa, Homo sapiens; identical to SEQ ID NO: 844038

SEQ ID NO: 844042 - protein, 431 aa, Homo sapiens; identical to SEQ ID NO: 844038

SEQ ID NO: 844043 - protein, 431 aa, Homo sapiens; identical to SEQ ID NO: 844038

SEQ ID NO: 844044 - protein, 431 aa, Homo sapiens; identical to SEQ ID NO: 844038

SEQ ID NO: 844045 - protein, 431 aa, Homo sapiens; identical to SEQ ID NO: 844038

SEQ ID NO: 844046 - protein, 431 aa, Homo sapiens; identical to SEQ ID NO: 844038

SEQ ID NO: 844047 - protein, 302 aa, Homo sapiens [sequence omitted]

SEQ ID NO: 844048 - protein, 431 aa, Homo sapiens; identical to SEQ ID NO: 844038

SEQ ID NO: 844049 - protein, 258 aa, Homo sapiens
PPGCRIRHERDKENGSVSSSETPPPPPPPNEINPPPHTMEEEEDDDWGEDTTEEAQRRRMDEISDHAKVLTLSDDLERTIEERVNILFDFVKKKKEEGVIDSSDKEIVAEAERLDVKAMGPLVLTEVLFNEKIREQIKKYRRHFLRCVVAMHQAQLISKIPHILKEMYDADLLEEEVIISWSEKASKKYVSKELAKEIRVKAEPFIKWLKEAEEESSGGEEEDEDENIEVVYSKAASVPKVETVKSDNKDDDIDIDAI

SEQ ID NO: 844050 - protein, 204 aa, Homo sapiens
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDLHVNPKKQTIGNSCKACGYRGMLDTHHKLCTFILKNPPENSDSGTGKKEKEKKNRKGKDKENGSVSSSETPPPPQPSSSSSSIVCGGGLISFGGGG

SEQ ID NO: 844051 - protein, 431 aa, Homo sapiens; identical to SEQ ID NO: 844038

SEQ ID NO: 844052 - protein, 431 aa, Homo sapiens; identical to SEQ ID NO: 844038

SEQ ID NO: 844053 - protein, 431 aa, Homo sapiens; identical to SEQ ID NO: 844038

SEQ ID NO: 844054 - protein, 431 aa, Homo sapiens; identical to SEQ ID NO: 844038

SEQ ID NO: 844055 - protein, 431 aa, Homo sapiens; identical to SEQ ID NO: 844038

SEQ ID NO: 844056 - protein, 431 aa, Homo sapiens; identical to SEQ ID NO: 844038

SEQ ID NO: 844057 - protein, 431 aa, Homo sapiens; identical to SEQ ID NO: 844038

SEQ ID NO: 844058 - protein, 431 aa, Homo sapiens; identical to SEQ ID NO: 844038

SEQ ID NO: 844059 - protein, 220 aa, Homo sapiens
PPGCRIRHERDKENGSVSSSETPPPPPPPNEINPPPHTMEEEEDDDWGEDTTEEAQRRRMDEISDHAKVLTLSDDLERTIEERVNILFDFVKKKKEEGVIDSSDKEIVAEAERLDVKAMGPLVLTEVLFNEKIREQIKKYRRHFLRFCHNNKKAQRYLLHGLECVVAMHQAQLISKIPHILKEMYDADLLEEEVIISWSEKIYKMVEGGRGRIFWWRRRR

SEQ ID NO: 844060 - protein, 431 aa, Homo sapiens; identical to SEQ ID NO: 844038

SEQ ID NO: 844061 - protein, 396 aa, Homo sapiens
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDLHVNPKKQTIGNSCKACGYRGMLDTHHKLCTFILKNPPENSDSGTGKKEKEKKNRKGKDKENGSVSSSETPPPPPPPNEINPPPHTMEEEEDDDWGEDTTEEAQRRRMDEISDHAKVLTLSDDLERTIEERVNILFDFVKKKKEEGVIDSSDKEIVAEAERLDVKAMGPLVLTEVLFNEKIREQIKKYRRHFLRFCHNNKKAQRYLLHGLECVVAMHQAQLISKIPHILKEMYDADLLEEEVIISWSEKASKKYVSKELAKEIRVKAEPKMRPCSGVFEGLQCPEVET

SEQ ID NO: 844062 - protein, 311 aa, Homo sapiens [sequence omitted]

SEQ ID NO: 844063 - protein, 162 aa, Homo sapiens
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDLHVNPKKQTIGNSCKACGYRGMLDTHHKLCTFILKNPPENSDSGTGKKKKKKKN

SEQ ID NO: 844064 - protein, 233 aa, Homo sapiens
RPPARKCAGAGKMAGGVRPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 844065 - protein, 209 aa, Homo sapiens
RPPARKCAGAGKMAGGVRPLRGLRALCRVLLFLSQFCILSGGEQSQALAQSIKDPGPTRTFTVVPRAAESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLVPTFPKGFFPIDLPAPPGPRLWLYPLPLVG

SEQ ID NO: 844066 - protein, 233 aa, Homo sapiens; identical to SEQ ID NO: 844064

SEQ ID NO: 844067 - protein, 233 aa, Homo sapiens; identical to SEQ ID NO: 844064

SEQ ID NO: 844068 - protein, 134 aa, Homo sapiens
MKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLVGQSSRTFVNKMFFSKFIEGTLTRNLRVKLLN

SEQ ID NO: 844069 - protein, 233 aa, Homo sapiens; identical to SEQ ID NO: 844064

SEQ ID NO: 844070 - protein, 185 aa, Homo sapiens
RPPARKCAGAGKMAGGVRPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLVGQSSRTFVNKMFFSKFIEGTLTRNLRVKLLN

SEQ ID NO: 844071 - protein, 164 aa, Homo sapiens
MKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLACTVCHLSITLGGFGADRFYLGQWREGLGKLFSFGGLGIWTLIDVLLIGVGYVGPADGSLYI

SEQ ID NO: 844072 - protein, 195 aa, Homo sapiens
RPPARKCAGAGKMAGGVRPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSLQAQVGLHVQLTVGLH

SEQ ID NO: 844073 - protein, 185 aa, Homo sapiens; identical to SEQ ID NO: 844070

SEQ ID NO: 844074 - protein, 203 aa, Homo sapiens
RPPARKCAGAGKMAGGVRPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALRVGLFIDTVTTPLHSSLSHRARHCL

SEQ ID NO: 844075 - protein, 259 aa, Homo sapiens
RPPARKCAGAGKMAGGVRPLRGLRALCRVLLFLSQFCILSGGEQSQALAQSIKDPGPTRTFTVVPRAAESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 844076 - protein, 185 aa, Homo sapiens; identical to SEQ ID NO: 844070

SEQ ID NO: 844077 - protein, 134 aa, Homo sapiens; identical to SEQ ID NO: 844068

SEQ ID NO: 844078 - protein, 182 aa, Homo sapiens
MKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 844079 - protein, 164 aa, Homo sapiens; identical to SEQ ID NO: 844071

SEQ ID NO: 844080 - protein, 185 aa, Homo sapiens; identical to SEQ ID NO: 844070

SEQ ID NO: 844081 - protein, 185 aa, Homo sapiens; identical to SEQ ID NO: 844070

SEQ ID NO: 844082 - protein, 145 aa, Homo sapiens
PPGPEVRSAGKMAGGVRPLRGLRALCRVLLFLSQFCILSGGGDVKGWVQRRVGLSGSRAPGAARRPGPRADADAGRRPSAGLRAACRCIWSLAPWPPGPRPPLRSGDTEPAIAAAEPWHGDGALGGWAGEAELERDVILRSLVAG

SEQ ID NO: 844083 - protein, 1169 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 844084 - protein, 189 aa, Homo sapiens
VRGRSKDPVFIDATQMDIWACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGSINTRGID

SEQ ID NO: 844085 - protein, 1086 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 844086 - protein, 1066 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFEYTGKQLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 844087 - protein, 1066 aa, Homo sapiens; identical to SEQ ID NO: 844086

SEQ ID NO: 844088 - protein, 720 aa, Homo sapiens
MNTVQVSPCQPLLSHRRFPKHCLSPQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFEYTGKQLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 844089 - protein, 1066 aa, Homo sapiens; identical to SEQ ID NO: 844086

SEQ ID NO: 844090 - protein, 528 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLR

SEQ ID NO: 844091 - protein, 143 aa, Homo sapiens
DVLKGEGLQLEIQAGDAVRIGGDGEWNQVHRDFQGWKRHFPALPSPCSQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 844092 - protein, 95 aa, Homo sapiens
FHFNPISHPICPHILGPRRSLLLPFTSPGMSSPLLASQSLSLPPSPAPSFLDQQIPAHVTLGWVLTSFTLPPACTTPSKHTSCFFIRQPGCFFPV

SEQ ID NO: 844093 - protein, 1086 aa, Homo sapiens; identical to SEQ ID NO: 844085

SEQ ID NO: 844094 - protein, 1086 aa, Homo sapiens; identical to SEQ ID NO: 844085

SEQ ID NO: 844095 - protein, 1066 aa, Homo sapiens; identical to SEQ ID NO: 844086

SEQ ID NO: 844096 - protein, 1010 aa, Homo sapiens
MLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFEYTGKQLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 844097 - protein, 667 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAVRRDG

SEQ ID NO: 844098 - protein, 382 aa, Homo sapiens
QISQILAQPGLNHHTLYTAHLFSLILLSLQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 844099 - protein, 76 aa, Homo sapiens
MFSLCSSLSISFNSSKHFHLYGSNASLAQVSPPPWKPQEQATEGAQEPQGRPRCGRAPGLCASQNFPLPEPSAWEK

SEQ ID NO: 844100 - protein, 315 aa, Homo sapiens
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVPSAGVILGCAKSPWMMAIGFPI

SEQ ID NO: 844101 - protein, 289 aa, Homo sapiens
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESVISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVTNAAANCPGQMTLHHKPFLACGGDGFTQSNFDGCITSALCVLEALKNYI

SEQ ID NO: 844102 - protein, 342 aa, Homo sapiens
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVTNAAANCPGQMTLHHKPFLACGGDGFTQSNFDGCITSALCVLEALKNYI

SEQ ID NO: 844103 - protein, 313 aa, Homo sapiens
AFSNSIDLMNQILHADDAVFTKRSSNQSVICQSNSLLIDYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVTNAAANCPGQMTLHHKPFLACGGDGFTQSNFDGCITSALCVLEALKNYI

SEQ ID NO: 844104 - protein, 342 aa, Homo sapiens; identical to SEQ ID NO: 844102

SEQ ID NO: 844105 - protein, 259 aa, Homo sapiens
MAQVLIVGAGMTGSLCAALLRRQTSGPLYLAVWDKAEDSGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVTNAAANCPGQMTLHHKPFLACGGDGFTQSNFDGCITSALCVLEALKNYI

SEQ ID NO: 844106 - protein, 40 aa, Homo sapiens
MRHRTHTQKHEKDRTRSDDNARNQSKRRHNDTHHQTRRDP

SEQ ID NO: 844107 - protein, 90 aa, Homo sapiens
MLQWITQHPSLGPMPLKMDLPPGDPGVLPLSCPQECPDPHSYPGPRSPTPGLPSSAVNDDLLLLPSSLPSVTKGLPRCQLWNEGCPWEVM

SEQ ID NO: 844108 - protein, 657 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMASGASSA

SEQ ID NO: 844109 - protein, 736 aa, Homo sapiens
ANGKTILRVAGQNESPRSRTGHTTSPRRLLSTSRRCSRRRRLAVRCQAAPSPGARRLACRGAPGRSCAPGAASGLLRPRHGLLQLRLLRRQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMASGASSA

SEQ ID NO: 844110 - protein, 624 aa, Homo sapiens
MEEQSCWYKGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMASGASSA

SEQ ID NO: 844111 - protein, 637 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQSDLIPDNVGYAQTCCSYHRLVPRSWQGLHSLATASLPTLLDFLCSCLVWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMASGASSA

SEQ ID NO: 844112 - protein, 449 aa, Homo sapiens
MTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMASGASSA

SEQ ID NO: 844113 - protein, 431 aa, Homo sapiens [sequence omitted]

SEQ ID NO: 844114 - protein, 628 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMSLWES

SEQ ID NO: 844115 - protein, 657 aa, Homo sapiens; identical to SEQ ID NO: 844108

SEQ ID NO: 844116 - protein, 657 aa, Homo sapiens; identical to SEQ ID NO: 844108

SEQ ID NO: 844117 - protein, 657 aa, Homo sapiens; identical to SEQ ID NO: 844108

SEQ ID NO: 844118 - protein, 657 aa, Homo sapiens; identical to SEQ ID NO: 844108

SEQ ID NO: 844119 - protein, 657 aa, Homo sapiens; identical to SEQ ID NO: 844108

SEQ ID NO: 844120 - protein, 657 aa, Homo sapiens; identical to SEQ ID NO: 844108

SEQ ID NO: 844121 - protein, 654 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMLKKR

SEQ ID NO: 844122 - protein, 614 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVVPLIIVCLFAFLVAHCFLSIYEMVVDVLFLCFAIDTKYNDGSPGREFYMDKVLMEFVENSRKAMKEAGKGGVADSRELKPMLKKR

SEQ ID NO: 844123 - protein, 299 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLDCKATSGPSYLCHINFRGHKDLIFCIGGYAHTCCSYL

SEQ ID NO: 844124 - protein, 657 aa, Homo sapiens; identical to SEQ ID NO: 844108

SEQ ID NO: 844125 - protein, 657 aa, Homo sapiens; identical to SEQ ID NO: 844108

SEQ ID NO: 844126 - protein, 221 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTTKKVSQRNCYS

SEQ ID NO: 844127 - protein, 657 aa, Homo sapiens; identical to SEQ ID NO: 844108

SEQ ID NO: 844128 - protein, 657 aa, Homo sapiens; identical to SEQ ID NO: 844108

SEQ ID NO: 844129 - protein, 654 aa, Homo sapiens; identical to SEQ ID NO: 844121

SEQ ID NO: 844130 - protein, 654 aa, Homo sapiens; identical to SEQ ID NO: 844121

SEQ ID NO: 844131 - protein, 103 aa, Homo sapiens
ANGKTILRVAGQNESPRSRTGHTTSPRRLLSTSRRCSRRRRLAVRCQAAPSPGARRLACRGAPGRSCAPGAASGLLRPRHGLLQLRLLRRAELQTRMEAAGGP

SEQ ID NO: 844132 - protein, 76 aa, Homo sapiens
QEEPKVVMGSGTFQFSRNIVVSLGGYISSFGTKTSEPTQHKVMRMGSRNFSSGSLKITHPGRYHQPRYETTPAVLW

SEQ ID NO: 844133 - protein, 161 aa, Homo sapiens
MLSLLNRRQEERLREQEERLHEQEERQREQEDRLHEQEERLREHEERLREQEERLCEQEERLREHEERLCEQEERLREQEERLCEQEERLREQEERLCEQEERLREQEERLCEQEKLPGQERLLEEVEKLLEQERRQEEQERLLERERLHAILFGLPRTGS

SEQ ID NO: 844134 - protein, 124 aa, Homo sapiens
MTCALNNLLHSLQLPESCSEIKHEAFKNHVFNVDNAKFVVKFDLSALTTIGNAKNSLIGMWALSPTVFALLSKNLMIVHSDLAVHFPAIQYAVLYTLYPHCTRHDHFIFSSLSSSSPSLFDGAV

SEQ ID NO: 844135 - protein, 79 aa, Homo sapiens
TCDKCHRIRPKECLRKLLKSSGVCSLVHSVVKSSGVCSLVLSVLKSSGVCSLVHSVVKSSVVCSLVLSVLKSSGVCSLV

SEQ ID NO: 844136 - protein, 69 aa, Homo sapiens
MACRAPGTSSPLCPAWDSPARREVCPGGDRLRAESSTEPRLTPVPPQRYSPVVEAGSDMVFRWTINDKQ

SEQ ID NO: 844137 - protein, 104 aa, Homo sapiens
IFMEKGAHTGHWLNPATGRFQQRRDITDLHEDRVLGTKKLRVGWKEMGYFLIIPATLEKGKVILHLMGQLIVLEAVHALAVFIPLPRCLCLLPRQQFMSRPCPC

SEQ ID NO: 844138 - protein, 201 aa, Homo sapiens [sequence omitted]

SEQ ID NO: 844139 - protein, 421 aa, Homo sapiens
MQALRHVVCALSGGVDSAVAALLLRRRGYQVTGVFMKNWDSLDEHGVCTADKDCEDAYRVCQILDIPFHQVSYVKEYWNDVFSDFLNEYEKGRTPNPDIVCNKHIKFSCFFHYAVDNLGADAIATGHYARTSLEDEEVFEQKHVKKPEGLFRNRFEVRNAVKLLQAADSFKDQTFFLSQVSQDALRRTIFPLGGLTKEFVKKIAAENRLHHVLQKKESMGMCFIGKRNFEHFLLQYLQPRPGHFISIEDNKVLGTHKGWFLYTLGQRANIGGLREPWYVVEKDSVKGDVFVAPRTDHPALYRDLLRTSRVHWIAEEPPAALVRDKMMECHFRFRHQMALVPCVLTLNQDGTVWVTAVQAVRALATGQFAVFYKGDECLGSGKILRLGPSAYTLQKGQRRAGMATESPSDSPEDGPGLSPLL

SEQ ID NO: 844140 - protein, 307 aa, Homo sapiens
MMCSGADAIATGHYARTSLEDEEVFEQKHVKKPEGLFRNRFEVRNAVKLLQAADSFKDQTFFLSQVSQDALRRTIFPLGGLTKEFVKKIAAENRLHHVLQKKESMGMCFIGKRNFEHFLLQYLQPRPGHFISIEDNKVLGTHKGWFLYTLGQRANIGGLREPWYVVEKDSVKGDVFVAPRTDHPALYRDLLRTSRVHWIAEEPPAALVRDKMMECHFRFRHQMALVPCVLTLNQDGTVWVTAVQAVRALATGQFAVFYKGDECLGSGKILRLGPSAYTLQKGQRRAGMATESPSDSPEDGPGLSPLL

SEQ ID NO: 844141 - protein, 201 aa, Homo sapiens [sequence omitted]

SEQ ID NO: 844142 - protein, 421 aa, Homo sapiens; identical to SEQ ID NO: 844139

SEQ ID NO: 844143 - protein, 153 aa, Homo sapiens
MMCSGADAIATGHYARTSLEDEEVFEQKHVKKPEGLFRNRFEVRNAVKLLQAADSFKDQTFFLSQVSQDALRRTIFPLGGLTKEFVKKIAAENRLHHVLQKKESMGMCFIGKRNFEHFLLQYLQPRPGHFISIEDNKVLGTHKGEVQTLPLVI

SEQ ID NO: 844144 - protein, 153 aa, Homo sapiens; identical to SEQ ID NO: 844143

SEQ ID NO: 844145 - protein, 103 aa, Homo sapiens
MDTVKTCSYVMGSARRAPGVTQGTQPHPGPRVRGSYSWNLHLLGHKVPSLWPPHPMSSPGLDNDEMCSGAWSGLALVVGESYLPSELHHCWACSGLPSQHLPS

SEQ ID NO: 844146 - protein, 307 aa, Homo sapiens; identical to SEQ ID NO: 844140

SEQ ID NO: 844147 - protein, 386 aa, Homo sapiens
MKNWDSLDEHGVCTADKDCEDAYRVCQILDIPFHQVSYVKEYWNDVFSDFLNEYEKGRTPNPDIVCNKHIKFSCFFHYAVDNLGADAIATGHYARTSLEDEEVFEQKHVKKPEGLFRNRFEVRNAVKLLQAADSFKDQTFFLSQVSQDALRRTIFPLGGLTKEFVKKIAAENRLHHVLQKKESMGMCFIGKRNFEHFLLQYLQPRPGHFISIEDNKVLGTHKGWFLYTLGQRANIGGLREPWYVVEKDSVKGDVFVAPRTDHPALYRDLLRTSRVHWIAEEPPAALVRDKMMECHFRFRHQMALVPCVLTLNQDGTVWVTAVQAVRALATGQFAVFYKGDECLGSGKILRLGPSAYTLQKGQRRAGMATESPSDSPEDGPGLSPLL

SEQ ID NO: 844148 - protein, 154 aa, Homo sapiens
MDHTEAGLGARCPSASPPSHSILQAPRTDHPALYRDLLRTSRVHWIAEEPPAALVRDKMMECHFRFRHQMALVPCVLTLNQDGTVWVTAVQAVRALATGQFAVFYKGDECLGSGKILRLGPSAYTLQKGQRRAGMATESPSDSPEDGPGLSPLL

SEQ ID NO: 844149 - protein, 166 aa, Homo sapiens
MQALRHVVCALSGGVDSAVAALLLRRRGYQVTGVFMKNWDSLDEHGVCTADKDCEDAYRVCQILDIPFHQVSYVKEYWNDVFSDFLNEYEKGRTPNPDIVCNKHIKFSCFFHYAVDNLGADAIATGHYARTSLEDEEVFEQKHVKKPEGLFRNRFEVRNARFPRMP

SEQ ID NO: 844150 - protein, 110 aa, Homo sapiens
MMCSGADAIATGHYARTSLEDEEVFEQKHVKKPEGLFRNRFEVRNAVKLLQAADSFKDQTFFLSQVSQDALRRTIFPLGGLTKEFVKKIAAENRLHHVLQKKEVRVSSCL

SEQ ID NO: 844151 - protein, 470 aa, Homo sapiens
GGGSGDRGLLFGAAAGGPRSGEAGGLPQLARSRPPLAGVGGRPLGRASPQAPPPRPRPAPPGLRGGTGRASPRGPATSGVAASALSAPDRRPSIAPRADAMKIKDAKKPSFPWFGMDIGGTLVKLSYFEPIDITAEEEQEEVESLKSIRKYLTSNVAYGSTGIRDVHLELKDLTLFGRRGNLHFIRFPTQDLPTFIQMGRDKNFSTLQTVLCATGGGAYKFEKDFRTIGNLHLHKLDELDCLVKGLLYIDSVSFNGQAECYYFANASEPERCQKMPFNLDDPYPLLVVNIGSGVSILAVHSKDNYKRVTGTSLGGGTFLGLCSLLTGCESFEEALEMASKGDSTQADKLVRDIYGGDYERFGLPGWAVASSFGNMIYKEKRESVSKEDLARATLVTITNNIGSVARMCAVNEKINRVVFVGNFLRVNTLSMKLLAYALDYWSKGQLKALFLEHEGYFGAVGALLGLPNFS

SEQ ID NO: 844152 - protein, 371 aa, Homo sapiens
GGGSGDRGLLFGAAAGGPRSGEAGGLPQLARSRPPLAGVGGRPLGRASPQAPPPRPRPAPPGLRGGTGRASPRGPATSGVAASALSAPDRRPSIAPRADAMKIKDAKKPSFPWFGMDIGGTLVKLSYFEPIDITAEEEQEEVESLKSIRKYLTSNVAYGSTGIRDVHLELKDLTLFGRRGNLHFIRFPTQDLPTFIQMGRDKNFSTLQTVLCATGGGAYKFEKDFRTIGNLHLHKLDELDCLVKGLLYIDSVSFNGQAECYYFANASEPERCQKMPFNLDDPYPLLVVNIGSGVSILAVHSKDNYKRVTGTSLGGGTFLGLCSLLTGCESFEEALEMASKGDSTQADKLVRDIYGGDYERFGLPGWAVASR

SEQ ID NO: 844153 - protein, 470 aa, Homo sapiens; identical to SEQ ID NO: 844151

SEQ ID NO: 844154 - protein, 837 aa, Homo sapiens
MMSEFYSITEDLKTCCQGHFEGFVGWKKCLWNPTPSSSGIFEKNSDKGHGDPGHPTSSFQFGYNIGVISAPETVIQDFLSYTLKERSEDSPSEVLLMSPWPLSVAIFPNGDMMAPFCCTLCQPLWQVQFNAYHNLLAITGCLMGFCRQAELVEMLILGQLDYWLVMRTLHKFCAHVHWRDLAYSPLGYLCALNQLDVVGILEIQIFGLEFILGSEELCPVILGFTILPAAYKVEPFHFALEVVSFCSLTERKSTNEILQQIVGDSGCVPGHLGDKSARMIQAKQVTTLALFRVPSYQQPTVISIMLQLSQQLSGINVVFYYSMRIFKDAGVEKPIYRLVQELVNIIFLTVVSLFVVERAGRTLHMIGLEAWRFVLSSWIVSLLLKDEYGGMSFVCSGAILVFVAFSEVGPDSVPWNTVATLFICNSSGWLLQLDLQLSSWIALPEQLLSSLSVLLLLGHGMLMYFCYHLTMVLCQVLLGDLNLSSRPHLREYESTGHSSQQPKIHTYFTEADLMIPLTSFLKLDFEQPISKDEKETLMHCRPLYTEKSLELLGLIFILKKSGNFFKCNHCQFAVRLGKQHKVIEFPITTTLTPREDCLLIERLVELVPFKFYTHLFQRLLVNLPCNLTWQFLAQLLYIKLEIRWSLSLGKVSTIASNIHGELKALKVVQIICQILDSIKISEVFFLLPLSVHVIAIMKYQSLKDCFYKQNDAAQSGKVFLLFQQYSCLQRVVHLALIFKVVFLDGKLNWIVIPYVLYNHSVYYKQSFFILYLFLLSTLCILVYCIGECSLEIHCLKPCEELIEDNENECHYFEFNLTVCGGCEQNIRNILSFCDNTL

SEQ ID NO: 844155 - protein, 470 aa, Homo sapiens; identical to SEQ ID NO: 844151

SEQ ID NO: 844156 - protein, 262 aa, Homo sapiens
MRQTLPLLLLTVLRPSWADPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALPPCTGPALSSLRALALAGNPLRALQPRAFACFPALQLLNLSCTALGRGAQGGIAEAAFAGEDGAPLVTLEVLDLSGTFLERVEVGSAGPCRNASIIHFVILQGEIAFVRDRSSCVGGASELSRMI

SEQ ID NO: 844157 - protein, 161 aa, Homo sapiens [sequence omitted]

SEQ ID NO: 844158 - protein, 289 aa, Homo sapiens
MRQTLPLLLLTVLRPSWADPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALPPCTGPALSSLRALALAGNPLRALQPRAFACFPALQLLNLSCTALGRGAQGGIAEAAFAGEDGAPLVTLEVLDLSGTFLERVEVESGWIRDLPKLTSLYLRKMPRLTTLEGDIFKMTPNLQQLDCQDSPALASVATHIFQDTPHLQVLLFQK

SEQ ID NO: 844159 - protein, 262 aa, Homo sapiens; identical to SEQ ID NO: 844156

SEQ ID NO: 844160 - protein, 199 aa, Homo sapiens
NFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQE

SEQ ID NO: 844161 - protein, 224 aa, Homo sapiens
GRILTHENLHIQDPILHRVEYIQGMVPQISSDLLQIPLSTSGTVPYLAFLSRFGGIDLYINGIKRGGGNEMNCCRTLRELEIQVGEKVFKNIKTVMKAFELIDVNKTGLVRPQELRRVLETFCMKLRDEEYEKFSKHYNIHKDTAVDYNVFLKNLSINNDLNLRYCMGNQEVSLENQQAKNSKKERLLGSASSEDIWRNYSLDEIERNFCLQVRCFPKPQLPTE

SEQ ID NO: 844162 - protein, 154 aa, Homo sapiens [sequence omitted]

SEQ ID NO: 844163 - protein, 767 aa, Homo sapiens
MGRRSRGRRLQQQQRPEDAEDGAEGGGKRGEAGWEGGYPEIVKENKLFEHYYQELKIVPEGEWGQFMDALREPLPATLRITGYKSHAKEILHCLKNKYFKELEDLEVDGQKVEVPQPLSWYPEELAWHTNLSRKILRKSPHLEKFHQFLVSETESGNISRQEAVSMIPPLLLNVRPHHKILDMCAAPGSKTTQLIEMLHADMNVPFPEGFVIANDVDNKRCYLLVHQAKRLSSPCIMVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKLQGKSAETRESTQLSPADLTEGKPTDPSKLESPSFTGTGDTEIAHATEDLENNGSKKDGVCGPPPSKKMKLFGFKEDPFVFIPEDDPLFPPIEKFYALDPSFPRMNLLTRTTEGKKRQLYMVSKELRNVLLNNSEKMKVINTGIKVWCRNNSGEEFDCAFRLAQEGIYTLYPFINSRIITVSMEDVKILLTQENPFFRKLSSETYSQAKDLAKGSIVLKYEPDSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 844164 - protein, 753 aa, Homo sapiens
SPPPPHNEEKRSLSKIFVPHPLHWTEQLPPNVWFFSTLRLQPIPVSPLQPAYFIQGLAVSLPTLRITGYKSHAKEILHCLKNKYFKELEDLEVDGQKVEVPQPLSWYPEELAWHTNLSRKILRKSPHLEKFHQFLVSETESGNISRQEAVSMIPPLLLNVRPHHKILDMCAAPGSKTTQLIEMLHADMNVPFPEGFVIANDVDNKRCYLLVHQAKRLSSPCIMVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKLQGKSAETRESTQLSPADLTEGKPTDPSKLESPSFTGTGDTEIAHATEDLENNGSKKDGVCGPPPSKKMKLFGFKEDPFVFIPEDDPLFPPIEKFYALDPSFPRMNLLTRTTEGKKRQLYMVSKELRNVLLNNSEKMKVINTGIKVWCRNNSGEEFDCAFRLAQEGIYTLYPFINSRIITVSMEDVKILLTQENPFFRKLSSETYSQAKDLAKGSIVLKYEPDSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 844165 - protein, 531 aa, Homo sapiens
MVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKLQGKSAETRESTQLSPADLTEGKPTDPSKLESPSFTGTGDTEIAHATEDLENNGSKKDGVCGPPPSKKMKLFGFKEDPFVFIPEDDPLFPPIEKFYALDPSFPRMNLLTRTTEGKKRQLYMVSKELRNVLLNNSEKMKVINTGIKVWCRNNSGEEFDCAFRLAQEGIYTLYPFINSRIITVSMEDVKILLTQENPFFRKLSSETYSQAKDLAKGSIVLKYEPDSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 844166 - protein, 139 aa, Homo sapiens
QKRPTVHPKQGKLSSETYSQAKDLAKGSIVLKYEPDSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 844167 - protein, 129 aa, Homo sapiens
PPQPTHNLRPHRPIRKGSIALLIEPHSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 844168 - protein, 666 aa, Homo sapiens
MGRRSRGRRLQQQQRPEDAEDGAEGGGKRGEAGWEGGYPEIVKENKLFEHYYQELKIVPEGEWGQFMDALREPLPATLRITGYKSHAKEILHCLKNKYFKELEDLEVDGQKVEVPQPLSWYPEELAWHTNLSRKILRKSPHLEKFHQFLVSETESGNISRQEAVSMIPPLLLNVRPHHKILDMCAAPGSKTTQLIEMLHADMNVPFPEGFVIANDVDNKRCYLLVHQAKRLSSPCIMVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKLQGKSAETRESTQLSPADLTEGKPTDPSKLESPSFTGTGDTEIAHATEDLENNGSKKDGVCGPPPSKKMKLFGFKEDPFVFIPEDDPLFPPIEKFYALDPSFPRMNLLTRTTEGKKRQLYMVSKELRNVLLNNSEKMKVINTGIKVWCRNNSGEEFDCAFRLAQEGIYTLYPFINSRIITVSMEDVKILLTQENPFFRKLSSETYSQAKDLAKGSIVLKYEPDSA

SEQ ID NO: 844169 - protein, 341 aa, Homo sapiens
MGRRSRGRRLQQQQRPEDAEDGAEGGGKRGEAGWEGGYPEIVKENKLFEHYYQELKIVPEGEWGQFMDALREPLPATLRITGYKSHAKEILHCLKNKYFKELEDLEVDGQKVEVPQPLSWYPEELAWHTNLSRKILRKSPHLEKFHQFLVSETESGNISRQEAVSMIPPLLLNVRPHHKILDMCAAPGSKTTQLIEMLHADMNVPFPEGFVIANDVDNKRCYLLVHQAKRLSSPCIMVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEV

SEQ ID NO: 844170 - protein, 531 aa, Homo sapiens; identical to SEQ ID NO: 844165

SEQ ID NO: 844171 - protein, 732 aa, Homo sapiens
MGRRSRGRRLQQQQRPEDAEDGAEGGGKRGEAGWEGGYPEIVKENKLFEHYYQELKIVPEGEWGQFMDALREPLPATLRITGYKRYPEELAWHTNLSRKILRKSPHLEKFHQFLVSETESGNISRQEAVSMIPPLLLNVRPHHKILDMCAAPGSKTTQLIEMLHADMNVPFPEGFVIANDVDNKRCYLLVHQAKRLSSPCIMVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKLQGKSAETRESTQLSPADLTEGKPTDPSKLESPSFTGTGDTEIAHATEDLENNGSKKDGVCGPPPSKKMKLFGFKEDPFVFIPEDDPLFPPIEKFYALDPSFPRMNLLTRTTEGKKRQLYMVSKELRNVLLNNSEKMKVINTGIKVWCRNNSGEEFDCAFRLAQEGIYTLYPFINSRIITVSMEDVKILLTQENPFFRKLSSETYSQAKDLAKGSIVLKYEPDSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 844172 - protein, 531 aa, Homo sapiens; identical to SEQ ID NO: 844165

SEQ ID NO: 844173 - protein, 450 aa, Homo sapiens
MGRRSRGRRLQQQQRPEDAEDGAEGGGKRGEAGWEGGYPEIVKENKLFEHYYQELKIVPEGEWGQFMDALREPLPATLRITGYKSHAKEILHCLKNKYFKELEDLEVDGQKVEVPQPLSWYPEELAWHTNLSRKILRKSPHLEKFHQFLVSETESGNISRQEAVSMIPPLLLNVRPHHKILDMCAAPGSKTTQLIEMLHADMNVPFPEGFVIANDVDNKRCYLLVHQAKRLSSPCIMVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKVSFSFSKMT

SEQ ID NO: 844174 - protein, 37 aa, Homo sapiens
GRRGKQVSLGPPYNNTNSIHHGSALITQLPPKSHTFQ

SEQ ID NO: 844175 - protein, 78 aa, Homo sapiens
FQLPFCVQYCVESWGFKDSVLLVWVAETYQKCFRGQLSFLIRKKYARVDRPECSSGPHGSQALILGKALLEGIARCKP

SEQ ID NO: 844176 - protein, 81 aa, Homo sapiens
SQSQKQTDSLLPAPNGPPNHWSTSPSHCCSNHKNSQSQKQTDSLLPAPNGPPNHWSTSPSHCCSNHKNSQSQKQTGSLLPA

SEQ ID NO: 844177 - protein, 298 aa, Homo sapiens
MLGRYREYSNGQAGAIEHLKESLEQSIDQLRSQRLLRNSGGRSISVTSLSASDLDGGTGSELHHFPPTSPLKDYGDPQGIKRMRSRTGVRFVQETDDMTQLHGFHQSLRDLSSEQIRLGDDFNRELSRRSRSDAETKRALEELTEKLNEAQKQEVVSDRVERRLQELEREMRTERELVERRQDQLGLMSLQLQEALKKQEAKADEHEGAIKNKLRQTETEKNQLEQELELSRRLLNQSEGSRETLLHQVEELRTQLTKAEGDRKGLQHQVSQISKQQSNYQDEQGEDWRFRRGKSRFV

SEQ ID NO: 844178 - protein, 361 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENVDRHVDLLEVAQETDGFSGSDLKEMCRDAALLCVREYVNSTSEESHDEDEIRPVQQQDLHRAIEKMKKSKDAAFQNVLTHVCLD

SEQ ID NO: 844179 - protein, 361 aa, Homo sapiens; identical to SEQ ID NO: 844178

SEQ ID NO: 844180 - protein, 361 aa, Homo sapiens; identical to SEQ ID NO: 844178

SEQ ID NO: 844181 - protein, 343 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENVDRHVDLLEVAQETDGFSGSDLKEMCRDAALLCVREYVNSTSEESHDEDEIRPVQQQDLHRAIEKMKKSKDAAFQNVLTHVCLD

SEQ ID NO: 844182 - protein, 287 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENLRKLKPREVL

SEQ ID NO: 844183 - protein, 361 aa, Homo sapiens; identical to SEQ ID NO: 844178

SEQ ID NO: 844184 - protein, 361 aa, Homo sapiens; identical to SEQ ID NO: 844178

SEQ ID NO: 844185 - protein, 141 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKAISIKCINLHIKGN

SEQ ID NO: 844186 - protein, 361 aa, Homo sapiens; identical to SEQ ID NO: 844178

SEQ ID NO: 844187 - protein, 343 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENVDRHVDLLEVAQETDGFSGSDLKEMCRDAALLCVREYVNSTSEESHDEDEIRPVQQQDLHRAIGLD

SEQ ID NO: 844188 - protein, 582 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALPSLNTGSSSPRGVEEPDVIFQNFLQQAASNQLDSLMGLSNSHPVEESIIIPCEFCGVQLEEEVLFHHQDQCDQRPATATNHVTEGIPRLDSQPQETSPELPRRRVRHQGDLSSGYLDDTKQETANGPTSCLPPSRPINNMTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAKAKPSKQQGAGDAEEEEEE

SEQ ID NO: 844189 - protein, 154 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPYECNA

SEQ ID NO: 844190 - protein, 582 aa, Homo sapiens; identical to SEQ ID NO: 844188

SEQ ID NO: 844191 - protein, 545 aa, Homo sapiens [sequence omitted]

SEQ ID NO: 844192 - protein, 582 aa, Homo sapiens; identical to SEQ ID NO: 844188

SEQ ID NO: 844193 - protein, 582 aa, Homo sapiens; identical to SEQ ID NO: 844188

SEQ ID NO: 844194 - protein, 574 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALPSLNTGSSSPRGVEEPDVIFQNFLQQAASNQLDSLMGLSNSHPVEESIIIPCEFCGVQLEEEVLFHHQDQCDQRPATATNHVTEGIPRLDSQPQETSPELPRRRVRHQGDLSSGYLDDTKQETANGPTSCLPPSRPINNMTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAKWKEGKILETW

SEQ ID NO: 844195 - protein, 564 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALPSLNTGSSSPRGVEEPDVIFQNFLQQAASNQLDSLMGLSNSHPVEESIIIPCEFCGVQLEEEVLFHHQDQCDQRPATATNHVTEGIPRLDSQPQETSPELPRRRVRHQGDLSSGYLDDTKQETANGPTSCLPPSRPINNMTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAK

SEQ ID NO: 844196 - protein, 540 aa, Homo sapiens [sequence omitted]

SEQ ID NO: 844197 - protein, 556 aa, Homo sapiens
GWVEAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALTLRHPNKLDQGRVPHAQEAGMGERRKTPGENWGSKFRVRKGKNPIYQCGKQAASNQLDSLMGLSNSHPVEESIIIPCEFCGVQLEEEVLFHHQDQCDQRPATATNHVTEGIPRLDSQPQETSPELPRRRVRHQGDLSSGYLDDTKQETANGPTSCLPPSRPINNMTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAKAKPSKQQGAGDAEEEEEE

SEQ ID NO: 844198 - protein, 125 aa, Homo sapiens
MTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAKAKPSKQQGAGDAEEEEEE

SEQ ID NO: 844199 - protein, 364 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALPSLNTGSSSPRGVEEPDVIFQNFLQQAASNQLDSLMGLSSISSSSG

SEQ ID NO: 844200 - protein, 113 aa, Homo sapiens
SEFVDLCSGTLQELVSNCFLSVVGVKVAGIPGSPLQLPTTAAELQRQSLPSNRELGMQKRKRRSNGVSRDFTSVPVFCAQQHLPLCRPTSLALWVGEFFQILDFSRLWPFCVF

SEQ ID NO: 844201 - protein, 298 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGRLAYSALASFSTVL

SEQ ID NO: 844202 - protein, 574 aa, Homo sapiens; identical to SEQ ID NO: 844194

SEQ ID NO: 844203 - protein, 607 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQNKLEAFTCLTLRHPNKLDQGRVPHAQEAGMGERRKTPGENWGSKFRVRKGKNPIYQCGKQAASNQLDSLMGLSNSHPVEESIIIPCEFCGVQLEEEVLFHHQDQCDQRPATATNHVTEGIPRLDSQPQETSPELPRRRVRHQGDLSSGYLDDTKQETANGPTSCLPPSRPINNMTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAKAKPSKQQGAGDAEEEEEE

SEQ ID NO: 844204 - protein, 582 aa, Homo sapiens; identical to SEQ ID NO: 844188

SEQ ID NO: 844205 - protein, 582 aa, Homo sapiens; identical to SEQ ID NO: 844188

SEQ ID NO: 844206 - protein, 524 aa, Homo sapiens
WKRAAGEGTEELEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALPSLNTGSSSPRGVEEPDVIFQNFLQQAASNQLDSLMGLSNSHPVEESIIIPCEFCGVQLEEEVLFHHQDQCDQRPATATNHVTEGIPRLDSQPQETSPELPRRRVRHQGDLSSGYLDDTKQETANGPTSCLPPSRPINNMTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAKAKPSKQQGAGDAEEEEEE

SEQ ID NO: 844207 - protein, 406 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALPSLNTGSSSPRGVEEPDVIFQNFLQQAASNQLDSLMGLSNSHPVEESIIIPCEFCGVQLEEEVLFHHQDQCDRRPAIGNHGLSRYRAR

SEQ ID NO: 844208 - protein, 262 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQAPGVYEALW

SEQ ID NO: 844209 - protein, 326 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELLEHLCLRPHGYHLLCSIHRSLLAAQAN

SEQ ID NO: 844210 - protein, 132 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLMGARWVLLPSVHNAVVVVLQSFVFTSFFPI

SEQ ID NO: 844211 - protein, 538 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWLAALSDRETRLQEVRSAFLAAYSSTVGLRAVAPSPSGAIGGLLEQFARGVGLRSISSNAL

SEQ ID NO: 844212 - protein, 108 aa, Homo sapiens [sequence omitted]

SEQ ID NO: 844213 - protein, 477 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAA

SEQ ID NO: 844214 - protein, 598 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRLAALSDRETRLQEVRSAFLAAYSSTVGLRAVAPSPSGAIGGLLEQFARGVGLRSISSNAL

SEQ ID NO: 844215 - protein, 650 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRSVDHPLPGSSLSTDYGSWQMVTGCGSIQERAVLHTDSSLPFSFPDELPNSCLLAALSDRETRLQEVRSAFLAAYSSTVGLRAVAPSPSGAIGGLLEQFARGVGLRSISSNAL

SEQ ID NO: 844216 - protein, 650 aa, Homo sapiens; identical to SEQ ID NO: 844215

SEQ ID NO: 844217 - protein, 383 aa, Homo sapiens
MAAGPAALRFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAA

SEQ ID NO: 844218 - protein, 411 aa, Homo sapiens
MVENKKVKFGMNVTSSEKVDKAQRYADFTLLSIPYPGCEFFKEYKDRDYMAEGLIFNWKQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRSVDHPLPGSSLSTDYGSWQMVTGCGSIQERAVLHTDSSLPFSFPDELPNSCLLAALSDRETRLQEVRSAFLAAYSSTVGLRAVAPSPSGAIGGLLEQFARGVGLRSISSNAL

SEQ ID NO: 844219 - protein, 650 aa, Homo sapiens; identical to SEQ ID NO: 844215

SEQ ID NO: 844220 - protein, 650 aa, Homo sapiens; identical to SEQ ID NO: 844215

SEQ ID NO: 844221 - protein, 356 aa, Homo sapiens
MARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAA

SEQ ID NO: 844222 - protein, 590 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRSVDHPLPGSSLSTDYGSWQMVTGCGSIQERAVLHTDSSLPFSFPDELPNSCL

SEQ ID NO: 844223 - protein, 436 aa, Homo sapiens
MVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRSVDHPLPGSSLSTDYGSWQMVTGCGSIQERAVLHTDSSLPFSFPDELPNSCLLAALSDRETRLQEVRSAFLAAYSSTVGLRAVAPSPSGAIGGLLEQFARGVGLRSISSNAL

SEQ ID NO: 844224 - protein, 538 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPR

SEQ ID NO: 844225 - protein, 127 aa, Homo sapiens
MTDCILSPLSPLCPRSVDHPLPGSSLSTDYGSWQMVTGCGSIQERAVLHTDSSLPFSFPDELPNSCLLAALSDRETRLQEVRSAFLAAYSSTVGLRAVAPSPSGAIGGLLEQFARGVGLRSISSNAL

SEQ ID NO: 844226 - protein, 245 aa, Homo sapiens
MFQRAQELRRRAEDYHKCKIPPSARKPLCNWVRMVAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRRRVDEVEQSPKPKRQREAEAQQLPKPKRRRLSKLRTRHCTQAWAIRINP

SEQ ID NO: 844227 - protein, 231 aa, Homo sapiens
MFQRAQELRRRAEDYHKCKIPPSARKPLCNWVRMVAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRQREAEAQQLPKPKRRRLSKLRTRHCTQAWAIRINP

SEQ ID NO: 844228 - protein, 179 aa, Homo sapiens
VCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 844229 - protein, 119 aa, Homo sapiens
SARWLIINNKPEEGLKELTKAAHRNGMKNAEDILTMEVLKSTMKQELEAAQKKHSLCELLRIPNICKRICFLSFVRSAGVCWRSTPDPVCLGITSGGCRTAKIPACSFLWKLHFRGAPA

SEQ ID NO: 844230 - protein, 119 aa, Homo sapiens
SARWLIINNKPEEGLKELTKAAHRNGMKNAEDILTMEVLKSTMKQELEAAQKKHSLCELLRIPNICKRICFLSFVRFASTIPFWGLTLAPSALWETMFSCCRLSLVQSPSWPIVLHLGH

SEQ ID NO: 844231 - protein, 120 aa, Homo sapiens
SYWQPAFWPSYLCLKVRKVHRWKKENVFPSFLRDCPGHTYLKPEGKGELSSQDSLIEIWGFRTDFATRKLLGNESKMSKIGSDIWLSSAHLRSSKKLVPFIPDSFSRTAIDHLPFGQSNS

SEQ ID NO: 844232 - protein, 64 aa, Homo sapiens
NEKTTPSPAEPTENGDRTPLANEKTTPSLAEPTENGQRTPFANEKTTSSSAEPTEHEERTPLAN

SEQ ID NO: 844233 - protein, 169 aa, Homo sapiens
MRGTPGDADGGGRAVYQSMCKPITGTINDLNQQVWTLQGQNLVAVPRSDSVTPVTVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 844234 - protein, 169 aa, Homo sapiens; identical to SEQ ID NO: 844233

SEQ ID NO: 844235 - protein, 36 aa, Homo sapiens
NWGFNIVRSKGDEPCSCGIFHSPHFTYALEVPWGLH

SEQ ID NO: 844236 - protein, 518 aa, Homo sapiens
KAEVWEGLRGGLRRSAGGWSSERVWAAAGSAMETVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRRDETMQPAKPSFLEYFEQKEKENQINSFGKSVPGPLKNSSDWKIPQDGDYEFLKSWTVEDLQKRLLALDPMMEQEIEEIRQKYQSKRQPILDAIEAKKRRQQNF

SEQ ID NO: 844237 - protein, 509 aa, Homo sapiens
KAEVWEGLRGGLRRSAGGWSSERVWAAAGSAMETVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRRDETMQPAKPSFLEYFEQKEKENQGPLKNSSDWKIPQDGDYEFLKSWTVEDLQKRLLALDPMMEQEIEEIRQKYQSKRQPILDAIEAKKRRQQNF

SEQ ID NO: 844238 - protein, 411 aa, Homo sapiens
MQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRRDETMQPAKPSFLEYFEQKEKENQINSFGKSVPGPLKNSSDWKIPQDGDYEFLKSWTVEDLQKRLLALDPMMEQEIEEIRQKYQSKRQPILDAIEAKKRRQQNF

SEQ ID NO: 844239 - protein, 467 aa, Homo sapiens
KAEVWEGLRGGLRRSAGGWSSERVWAAAGSAMETVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKSKALSKFTDFLDQAYIFQRRQILMVHAGLALGSFFCHNQRSRKLGSLRWGQEVW

SEQ ID NO: 844240 - protein, 265 aa, Homo sapiens
GQIPFHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRRDETMQPAKPSFLEYFEQKEKENQINSFGKSVPGPLKNSSDWKIPQDGDYEFLKSWTVEDLQKRLLALDPMMEQEIEEIRQKYQSKRQPILDAIEAKKRRQQNF

SEQ ID NO: 844241 - protein, 70 aa, Homo sapiens
KAEVWEGLRGGLRRSAGGWSSERVWAAAGSAMETVQLRNPPRRQLKKLDEDSLTKQPEEVFDVLEKLGEG

SEQ ID NO: 844242 - protein, 518 aa, Homo sapiens; identical to SEQ ID NO: 844236

SEQ ID NO: 844243 - protein, 446 aa, Homo sapiens
KAEVWEGLRGGLRRSAGGWSSERVWAAAGSAMETVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRREETRAASETIIREYQEQERQRANQSNTRGKS

SEQ ID NO: 844244 - protein, 231 aa, Homo sapiens
KAEVWEGLRGGLRRSAGGWSSERVWAAAGSAMETVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTVSKNITCIDNFHFCPEKQFLLFTYF

SEQ ID NO: 844245 - protein, 217 aa, Homo sapiens
LVNDSLNFHRYRCMVADEMGLGKTIQAIGITYFYKEEWPLLIVVPSSLRYPWTEEIEKWIPELSPEEINVIQNKTDVRRMLTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRVSLPSPRLDCSGTIMAHYNLCLLGSIDSSALAS

SEQ ID NO: 844246 - protein, 283 aa, Homo sapiens
LGFRVALGLRVAEFREFLLTRRIIMPRVHNIKKSLTPHISCVTNESDNLLDFLPDRLRAKLLPFQKDGIIFALKRNGRCMVAYEMGLGKTIQAIGITYFYKEEWPLLIVVPSSLRYPWTEEIEKWIPELSPEEINVIQNKTDVRRMLTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRVSLPSPRLDCSGTIMAHYNLCLLGSIDSSALAS

SEQ ID NO: 844247 - protein, 259 aa, Homo sapiens
MPRVHNIKKSLTPHISCVTNESDNLLDFLPDRLRAKLLPFQKDGIIFALKRNGRCMVAYEMGLGKTIQAIGITYFYKEEWPLLIVVPSSLRYPWTEEIEKWIPELSPEEINVIQNKTDVRRMLTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRVSLPSPRLDCSGTIMAHYNLCLLGSIDSSALAS

SEQ ID NO: 844248 - protein, 135 aa, Homo sapiens
LGFRVALGLRVAEFREFLRDSQMGLGKTIQAIGITYFYKEEWPLLIVVPSSLRYPWTEEIEKWIPELSPEEINVIQNKTDVRDMSTSYQLTDSAAYWLYLDRSMHTALSDSALQLQLTQQPFTQLRLLRWMNHTT

SEQ ID NO: 844249 - protein, 63 aa, Homo sapiens
LLLIRAQEQKGVEGESVGGHKHGVEVSGQGLTWGTGEAPIFRREGRGGAPGFAGPVSEKISPP

SEQ ID NO: 844250 - protein, 111 aa, Homo sapiens
MFTPEQIMGKDVRLLRIKKEGSLDLALEGGVDSPIGKVVVSAVYERGAAERHGGIVKGDEIMAINGKIVTDYTLAEADAALQKAWNQGGDWIDLVVAVCPPKEYDDELTFF

SEQ ID NO: 844251 - protein, 563 aa, Homo sapiens [sequence omitted]

SEQ ID NO: 844252 - protein, 561 aa, Homo sapiens
YELSSTQRSLKALIRHYSHHQVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKYDQGVEPELEPADDLDGGTEEQGEQDFRKYEEGFDPYSMFTPEQIMGKDVRLLRIKKEGSLDLALEGGVDSPIGKVVVSAVYERGAAERHGGIVKGDEIMAINGKIVTDYTLAEADAALQKAWNQGGDWIDLVVAVCPPKEYDDELTFF

SEQ ID NO: 844253 - protein, 506 aa, Homo sapiens
APRAAGPVAVAALSSSWQPGTRRNGSCNDAAGPGPAMDRKVAREFRHKVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKYDQGVEPELEPADDLDGGTEEQGEQLLDGFIVTMANSQPSGRAVRDSLSPSSWNAKSPGNASGYPWP

SEQ ID NO: 844254 - protein, 588 aa, Homo sapiens
APRAAGPVAVAALSSSWQPGTRRNGSCNDAAGPGPAMDRKVAREFRHKVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKYDQGVEPELEPADDLDGGTEEQGEQDFRKYEEGFDPYSMFTPEQIMGKDVRLLRIKKEGSLDLALEGGVDSPIGKVVVSAVYERGAAERHGGIVKGDEIMAINGKIVTDYTLAEADAALQKAWNQGGDWIDLVVAVCPPKEYDDELTFF

SEQ ID NO: 844255 - protein, 563 aa, Homo sapiens
APRAAGPVAVAALSSSWQPGTRRNGSCNDAAGPGPAMDRKVAREFRHKVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPYPFASQSDFRKYEEGFDPYSMFTPEQIMGKDVRLLRIKKEGSLDLALEGGVDSPIGKVVVSAVYERGAAERHGGIVKGDEIMAINGKIVTDYTLAEADAALQKAWNQGGDWIDLVVAVCPPKEYDDELTFF

SEQ ID NO: 844256 - protein, 521 aa, Homo sapiens [sequence omitted]

SEQ ID NO: 844257 - protein, 447 aa, Homo sapiens
LGPFPVQNQGPAESHDPFLRPGCQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKYDQGVEPELEPADDLDGGTEEQGEQDFRKYEEGFDPYSMFTPEQIMGKDVRLLRIKKEGSLDLALEGGVDSPIGKVVVSAVYERGAAERHGGIVKGDEIMAINGKIVTDYTLAEADAALQKAWNQGGDWIDLVVAVCPPKEYDDELTFF

SEQ ID NO: 844258 - protein, 147 aa, Homo sapiens
PYSSALTLKTLCCVALKPSLCFQDFRKYEEGFDPYSMFTPEQIMGKDVRLLRIKKEGSLDLALEGGVDSPIGKVVVSAVYERGAAERHGGIVKGDEIMAINGKIVTDYTLAEADAALQKAWNQGGDWIDLVVAVCPPKEYDDELTFF

SEQ ID NO: 844259 - protein, 2486 aa, Homo sapiens
MVLLLCLSCLIFSCLTFSWLKIWEKMTDSKPITKSKSEANLIPSQEPFPASDNSGETPQRNGEGHTLHKDTQPGRAQPPTKAQRSGRRRNSLPPSRQKPPRNPLSSSDAAPSPELQANGTGTQGLEATDTNGLSSSARPQGSKLVPSKEDKKQANIKRQLMTNFILGSFDDYSSDEDSVAGSSRESTRKGSRASLGALSLEAYLTTGEAETRVPTMRPSMSGLHLVKRGREHKKLDLHRDFTVASPAEFVTRFGGDRVIEKVLIANNGIAAVKCMRSIRRWAYEMFRNERAIRFVRMVTPEDLKANAEYIKMADHYGPAPGGPNNNNYANVELIVDIAKRIPLQAVWAGWGHALENPKLPELLCKNGVAFLGPPRLRPMVGLGDKIASTVVAQTLQVPTLPRSGSALTVEWTEDDLQQGKRISVPEDVYDKGCVKDVDEGLEAAERIGFPLMIKASEGGGGKGIRETESAEDFPILFRQVQSEIPGSPIFLMKLAQHARHLEVQILADQYGNAVSLFGRDCSIQRRHQKIVEEAPATIAPLAIFEFMEQCAIRLAKTVGYVSAGTVEYLYSQDGSFHFLELNPRLQVEHPCTEMIADVNLPAAQLQIAMGAPLHRLKDIRLLYGESPWGDSPISFENSAHLPCPRGHVIATRITSENPDEGFKPSSGTVQELNFRSSKNVWGYFTVAATGGLHEFAISQFGHCFSWGENREEAISNMVVALKELSIRGDFRTTVEYLINLLETESFQNNDIDTGWLDYLIAEKVQAEKPDIMLGVVCGALERGDAMFRTCMTDFLHSLERGQVLPADSLLNLVDVELIYEGVKYILKVTRQSLTMFVLIMNGCHIEIDAHRLNDGGLLLSYNGNSYTTYMKEEVDSYRITIGNKTCVFEKENDPTVLRSPSAGKLTQYTVEDGGHVEAGSSYAEMEVMKMIMTLNVQERGRVKYIKRPGAVLEAGCVVARLELDDPSKVHPAEPFTGELPAQQTLPILGEKLHQVFHSVLGSLTNVMSGFCLPEPFFSIKLKEWVQKLMMTLRHPSLLLDVQEIMTSRAGRIPPPVEKSVRKVMAQYASNITSVLCQFPSQQIATILDCHAATLQRKADREVFFINTQSIVQLVQRYRSGIRGYMKTVVMDLLRRYLRVETIFSKARDADANSSGMVGGVRSLSFTSVWVVLSPPAHYDKCVINLREQFKPDMSQVLDCIFSHAQVAKKNQLVIMLIDELCGPDPSLSDELISILNELTQLSKSEHCKVALRARQILIASTPSYELRHNQVESIFLSAIDMYGHQFCPENLQKLILSETTIFDVLNTFFYHANKVVCMASLEVYVGGAYIAYVLNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAIKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 844260 - protein, 2486 aa, Homo sapiens; identical to SEQ ID NO: 844259

SEQ ID NO: 844261 - protein, 2486 aa, Homo sapiens; identical to SEQ ID NO: 844259

SEQ ID NO: 844262 - protein, 1056 aa, Homo sapiens
MTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAIKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 844263 - protein, 250 aa, Homo sapiens
GPPCDRVCIESMQTKRAGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 844264 - protein, 687 aa, Homo sapiens
MTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVTKKGPVQSGSLGARSHFNIPIGLWWGIFLNMKPVSFLLIQELFFSNLQLSGSL

SEQ ID NO: 844265 - protein, 532 aa, Homo sapiens
MTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKVRRETGGAG

SEQ ID NO: 844266 - protein, 71 aa, Homo sapiens
AQAIKDFNREKLPLMIFANWRGFSGGMKGKPLPAYVTPKPWGQHPGQHPLGGDANVLVCAHHHLSCVSQQP

SEQ ID NO: 844267 - protein, 1785 aa, Homo sapiens
MLKNLNIRVPSLIAKDTDAEVWDKGLVWELHCFSWGENREEAISNMVVALKELSIRGDFRTTVEYLINLLETESFQNNDIDTGWLDYLIAEKVQAEKPDIMLGVVCGALERGDAMFRTCMTDFLHSLERGQVLPADSLLNLVDVELIYEGVKYILKVTRQSLTMFVLIMNGCHIEIDAHRLNDGGLLLSYNGNSYTTYMKEEVDSYRITIGNKTCVFEKENDPTVLRSPSAGKLTQYTVEDGGHVEAGSSYAEMEVMKMIMTLNVQERGRVKYIKRPGAVLEAGCVVARLELDDPSKVHPAEPFTGELPAQQTLPILGEKLHRVFHSVLGSLTNVMSGFCLPEPFFSIKLKEWVQKLMMTLRHPSLLLDVQEIMTSRAGRIPPPVEKSVRKVMAQYASNITSVLCQFPSQQIATILDCHAATLQRKADREVFFINTQSIVQLVQRYRSGIRGYMKTVVMDLLRRYLRVEHHFQQAHYDKCVINLREQFKPDMSQVLDCIFSHAQVAKKNQLVIMLIDELCGPDPSLSDELISILNELTQLSKSEHCKVALRARQILIASPPSYELRHNQVESIFLSAIDMYGHQFCPENLQKLILSETTIFDVLNTFFYHANKVVCMASLEVYVGGAYIAYVLNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAIKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 844268 - protein, 1786 aa, Homo sapiens
CWDYRREPPHPATPVLFQFSESHHCSNSVDVCMNLEMIHVPFPSRNMVVALKELSIRGDFRTTVEYLINLLETESFQNNDIDTGWLDYLIAEKVQAEKPDIMLGVVCGALERGDAMFRTCMTDFLHSLERGQVLPADSLLNLVDVELIYEGVKYILKVTRQSLTMFVLIMNGCHIEIDAHRLNDGGLLLSYNGNSYTTYMKEEVDSYRITIGNKTCVFEKENDPTVLRSPSAGKLTQYTVEDGGHVEAGSSYAEMEVMKMIMTLNVQERGRVKYIKRPGAVLEAGCVVARLELDDPSKVHPAEPFTGELPAQQNTAHLGEKLHQVFHSVLGSLTNVMSGFCLPEPFFSIKLKEWVQKLMMTLRHPSLLLDVQEIMTSRAGRIPPPVEKSVRKVMAQYASNITSVLCQFPSQQIATILDCHAATLQRKADREVFFINTQSIVQLVQRYRSGIRGYMKTVVMDLLRRYLRVEHHFQQAHYDKCVINLREQFKPDMSQVLDCIFSHAQVAKKNQLVIMLIDELCGPDPSLSDELISILNELTQLSKSEHCKVALRARQILIASTPSYELRHNQVESIFLSAIDMYGHQFCPENLQKLILSETTIFDVLNTFFYHANKVVCMASLEVYVGGAYIAYVLNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAIKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 844269 - protein, 1124 aa, Homo sapiens
MTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAIKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 844270 - protein, 419 aa, Homo sapiens
MTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQASPAAQTRYPLGPPSRLHQNQSPSLIL

SEQ ID NO: 844271 - protein, 106 aa, Homo sapiens
IVTKFSWKFPSLCGFFPVPLAALPKDFCKTKSEVTSLGTESPQGSSYCFFYPCISLSSLNLSQLQEGRDFNLGNKSTEHEISEGVWDTSWLHKNPFTIVPASLSSK

SEQ ID NO: 844272 - protein, 106 aa, Homo sapiens
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQVRKLIII

SEQ ID NO: 844273 - protein, 181 aa, Homo sapiens
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQF

SEQ ID NO: 844274 - protein, 69 aa, Homo sapiens
AVLSLEFGQTTNGDRVLGSGPAGTATPPRDSLSLPLTIAGAHGLLTTCQVLLSLDQPLRQQVLPLPPGH

SEQ ID NO: 844275 - protein, 69 aa, Homo sapiens; identical to SEQ ID NO: 844274

SEQ ID NO: 844276 - protein, 201 aa, Homo sapiens
CTGEIEDLHCLYSMQPIGRQLIAKEGNTLLLFAINSRRQHMVEFLLKNQANIHAVDNFKRTALILAVQHNLSSIVTLLLQQNIHISSQDMFGQTAEDYAFCCDLRSIQQQILEHKNKMLKNHLRNDNQETAAMKPDTLDPTRTTQEHNGQPQDTAGAQAEHNLKVASEEKDQDRLGRKLTPQGQRDLDRIAGQVAAANKKH

SEQ ID NO: 844277 - protein, 124 aa, Homo sapiens
AERLLSHHANIEALNKEGNTLLLFAINSRRQHMVEFLLKNQANIHAVDNFKRTALILAVQHNLSSIVTLLLQQNIHISSQDMFGQTAEDYAFCCDLRSIQQQILEHKNKMLKNHLRNDNQKQQL

SEQ ID NO: 844278 - protein, 132 aa, Homo sapiens
EAAAMKNESFKTQGASSKVSLYHQSGVQWHDLRLLQPSPPRFKQFSCLSLPRSWDNRHMRPCPETAAMKPENLKKRKKRKKLKKRKEGAKEHNLKVASEEKDQDRLGRKLTPQGQRDLDRIAGQVAAANKKH

SEQ ID NO: 844279 - protein, 104 aa, Homo sapiens
PLTEFPPLTEFQELLPGIGITGSYSVSESPFFSPIHLHSNVAWTVEDPVDSAPPGQRKKEQWYAGINPSDGINSEVLEAIRVTRHKNAMAERWESRIYASEEDD

SEQ ID NO: 844280 - protein, 679 aa, Homo sapiens
MDRVTRYPILGIPQAHRGTGLVLDGDTSYTYHLVCMGPEASGWGQDEPQTWPTDHRAQQGVQRQGVSYSVHAYTGQPSPRGLHSENREDEGWQVYRLGARDAHQGRPTWALRPEDGEDKEMKTYRLDAGDADPRRLCDLERERWAVIQGQAVRKSSTVATLQGTPDHGDPRTPGPPRSTPLEENVVDREQIDFLAARQQFLSLEQANKGAPHSSPARGTPAGTTPGASQAPKAFNKPHLANGHVVPIKPQVKGVVREENKVRAVPTWASVQVVDDPGSLASVESPGTPKETPIEREIRLAQEREADLREQRGLRQATDHQELVEIPTRPLLTKLSLITAPRRERGRPSLYVQRDIVQETQREEDHRREGLHVGRASTPDWVSEGPQPGLRRALSSDSILSPAPDARAADPAPEVRKVNRIPPDAYQPYLSPGTPQLEFSAFGAFGKPSSLSTAEAKAATSPKATMSPRHLSESSGKPLSTKQEASKPPRGCPQANRGVVRWEYFRLRPLRFRAPDEPQQAQVPHVWGWEVAGAPALRLQKSQSSDLLERERESVLRREQEVAEERRNALFPEVFSPTPDENSDQNSRSSSQASGITGSYSVSESPFFSPIHLHSNVAWTVEDPVDSAPPGQRKKEQWYAGINPSDGINSEVLEAIRVTRHKNAMAERWESRIYASEEDD

SEQ ID NO: 844281 - protein, 229 aa, Homo sapiens
MGDPNSRKKQALNRLRAQLRKKKESLADQFDFKMYIAFVFKEKKKKSALFEVSEVIPVMTNNYEENILKGVRDSSYSLESSLELLQKDVVQLHAPRYQSMRRDVIGCTQEMDFILWPRNDIEKIVCLLFSRWKESDEPFRPVQAKFEFHHGDYEKQFLHVLSRKDKTGIVVNNPNQSVFLFIDRQHLQTPKNKATIFKLCSICLYLPQEQLTHWAVGTIEDHLRPYMPE

SEQ ID NO: 844282 - protein, 229 aa, Homo sapiens; identical to SEQ ID NO: 844281

SEQ ID NO: 844283 - protein, 229 aa, Homo sapiens; identical to SEQ ID NO: 844281

SEQ ID NO: 844284 - protein, 229 aa, Homo sapiens; identical to SEQ ID NO: 844281

SEQ ID NO: 844285 - protein, 229 aa, Homo sapiens; identical to SEQ ID NO: 844281

SEQ ID NO: 844286 - protein, 229 aa, Homo sapiens; identical to SEQ ID NO: 844281

SEQ ID NO: 844287 - protein, 113 aa, Homo sapiens [sequence omitted]

SEQ ID NO: 844288 - protein, 229 aa, Homo sapiens; identical to SEQ ID NO: 844281

SEQ ID NO: 844289 - protein, 149 aa, Homo sapiens
MGDPNSRKKQALNRLRAQLRKKKESLADQFDFKMYIAFVFKEKKKKSALFEVSEVIPVMTNNYEENILKGVRDSSYSLESSLELLQKDVVQLHAPRYQSMRRDVIGCTQEMDFILWPRNDIEKIVCLLFSRWKESDEPFRPVQVFWSKV

SEQ ID NO: 844290 - protein, 229 aa, Homo sapiens; identical to SEQ ID NO: 844281

SEQ ID NO: 844291 - protein, 160 aa, Homo sapiens
MGDPNSRKKQALNRLRAQLRKKKESLADQFDFKMYIAFVFKEKKKKSALFEVSEVIPVMTNNYEENILKGVRDSSYSLESSLELLQKDVVQLHAPRYQSMRRDVIGCTQEMDFILWPRNDIEKIVCLLFSRWKESDEPFRPVQWFDDKNPIWAGRGCSRL

SEQ ID NO: 844292 - protein, 160 aa, Homo sapiens; identical to SEQ ID NO: 844291

SEQ ID NO: 844293 - protein, 733 aa, Homo sapiens
NVGAKQHGREAAAACRALSSGTLDFRTLSAMALPLLPGNSFNRNVKGDGSDVPSWVAFDKQVLSFDAYLEEEVLDKSQTNYRIRYYKIYFYPEDDTIQVNEPEVKNSGLLQGTSIRRHRITLPPPDEDQFYTVYHFNVGTEVVFYGRTFKIYDCDAFTRNFLRKIGVKVNPPVQCPEDPYMKIRREVVEHVEPLRPYESLDTLKQFLQYHGKILCFFCLWDDSVSMFGDRRELILHYFLCDDTIEIKELLPHSSGRDALKMFLRRSKLPKNCPPRVYQPGQITDRAVLNSYGDFIKNQADGYLFDRYKLGKVDQEFYKDSDLSLGVTINVWGRKVLLYDCDEFTKSYYKSKYGIENFTSVSCKPPSPPPKIERKFPPYNGFGSEEDSLRNCIDLKPTPHRRNFKKFMEKDSYGSKSNILRFFCKLVTDKCVDLDRMFVISYYLGDDTISVFEPIERNSGIAGGMFLKRSRVKKPGQEVFKSELSEYIKAEELYIGVTVNVNGYLFRLLNADEYTLNYMEQNTDKYPFSNLKLALQKLKQEEGKSRELKQVFKAADSKHTNMVDYNTFRDILMSLTVGNLAEQEFVTIARHYRVPEGTCSDMDFLIALAHEKFKKNMFENFDTFIYSCVYEDREKKNVLPTKDIKRLCKSSRLPLSDDLLESLLSRFEDSEKQIDYKSFFSALNWRKNPVPELQPASYLKERCEDVWLGMPSPIPAKYIDYWTFLKDAFGLEEE

SEQ ID NO: 844294 - protein, 469 aa, Homo sapiens
FDFVFQNCPPRVYQPGQITDRAVLNSYGDFIKNQADGYLFDRYKLGKVDQEFYKDSDLSLGVTINVWGRKVLLYDCDEFTKSYYKSKYGIENFTSVSCKPPSPPPKIERKFPPYNGFGSEEDSLRNCIDLKPTPHRRNFKKFMEKDSYGSKSNILRFFAKLVTDKCVDLDRMFVISYYLGDDTISVFEPIERNSGIAGGMFLKRSRVKKPGQEVFKSELSEYIKAEELYIGVTVNVNGYLFRLLNADEYTLNYMEQNTDKYPFSNLKLALQKLKQEEGKSRELKQVFKAADSKHTNMVDYNTFRDILMSLTVGNLAEQEFVTIARHYRVPEGTCSDMDFLIALAHEKFKKNMFENFDTFIYSCVYEDREKKNVLPTKDIKRLCKSSRLPLSDDLLESLLSRFEDSEKQIDYKSFFSALNWRKNPVPELQPASYLKERCEDVWLGMPSPIPAKYIDYWTFLKDAFGLEEE

SEQ ID NO: 844295 - protein, 162 aa, Homo sapiens
MSLTVGNLAEQEFVTIARHYRVPEGTCSDMDFLIALAHEKFKKNMFENFDTFIYSCVYEDREKKNVLPTKDIKRLCKSSRLPLSDDLLESLLSRFEDSEKQIDYKSFFSALNWRKNPVPELQPASYLKERCEDVWLGMPSPIPAKYIDYWTFLKDAFGLEEE

SEQ ID NO: 844296 - protein, 779 aa, Homo sapiens
RGGQTTRPGGGRCLPGPLFWDPGFSDTERHGPASAAGQQLQPQRVGKEKFHKSQHWGFCNNVMMLVSDEKPGIGGEPLLGQKIKPKCSIYPKGDGSDVPSWVAFDKQVLSFDAYLEEEVLDKSQTNYRIRYYKIYFYPEDDTIQVNEPEVKNSGLLQGTSIRRHRITLPPPDEDQFYTVYHFNVGTEVVFYGRTFKIYDCDAFTRNFLRKIGVKVNPPVQCPEDPYMKIRREVVEHVEPLRPYESLDTLKQFLQYHGKILCFFCLWDDSVSMFGDRRELILHYFLCDDTIEIKELLPHSSGRDALKMFLRRSKLPKNCPPRVYQPGQITDRAVLNSYGDFIKNQADGYLFDRYKLGKVDQEFYKDSDLSLGVTINVWGRKVLLYDCDEFTKSYYKSKYGIENFTSVSCKPPSPPPKIERKFPPYNGFGSEEDSLRNCIDLKPTPHRRNFKKFMEKDSYGSKSNILRFFCKLVTDKCVDLDRMFVISYYLGDDTISVFEPIERNSGIAGGMFLKRSRVKKPGQEVFKSELSEYIKAEELYIGVTVNVNGYLFRLLNADEYTLNYMEQNTDKYPFSNLKLALQKLKQEEGKSRELKQVFKAADSKHTNMVDYNTFRDILMSLTVGNLAEQEFVTIARHYRVPEGTCSDMDFLIALAHEKFKKNMFENFDTFIYSCVYEDREKKNVLPTKDIKRLCKSSRLPLSDDLLESLLSRFEDSEKQIDYKSFFSALNWRKNPVPELQPASYLKERCEDVWLGMPSPIPAKYIDYWTFLKDAFGLEEE

SEQ ID NO: 844297 - protein, 349 aa, Homo sapiens
MGDMGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTNIQGMTGTPMVAASPERHDGGLQANPVEVQSYQPPWKVLSDFALQSDIDQPAFQQLVNFSEGGPGSNSTGSEVASMSSQLPDTPNSMVASPIEA

SEQ ID NO: 844298 - protein, 349 aa, Homo sapiens; identical to SEQ ID NO: 844297

SEQ ID NO: 844299 - protein, 74 aa, Homo sapiens
ADTISTSVQSEIDSLLFSNVVNFSEGGPGSNSTGSEVASMSSQLPDTRGKRSDWISNPNKLPVHFWGKSRAILP

SEQ ID NO: 844300 - protein, 285 aa, Homo sapiens
MEPIKIVPWLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTNIQGMTGTPMVAASPERHDGGLQANPVEVQSYQPPWKVLSDFALQSDIDQPAFQQLVNFSEGGPGSNSTGSEVASMSSQLPDTPNSMVASPIEA

SEQ ID NO: 844301 - protein, 145 aa, Homo sapiens
MAKSLRSKWKRKMRAEKRKKNAPKEASRLKSILKLDGDVLMKDVQEIATVVVPKPKHCQEKMQCEVKDEKDDMKMETDIKRNKKTLLDQHGQYPIWMNQRQRKRLKAKREKRKKKKKKKKIVGGAWAPEKNLLENLCAGGRRAGP

SEQ ID NO: 844302 - protein, 129 aa, Homo sapiens
MAKSLRSKWKRKMRAEKRKKNAPKEASRLKSILKLDGDVLMKDVQEIATVVVPKPKHCQEKMQCEVKDEKDDMKMETDIKRNKKTLLDQHGQYPIWMNQRQRKRLKAKREKRKGKSKAKAVKVAKGLAW

SEQ ID NO: 844303 - protein, 129 aa, Homo sapiens; identical to SEQ ID NO: 844302

SEQ ID NO: 844304 - protein, 88 aa, Homo sapiens
RLRIQLVPRSFIPSITPQVCFGNLNKIFSLIHPSSTDTLTGCYPISSYNQASTFCQVLIWLELFLQLVIIVNRDKTDDVLTNFCELRF

SEQ ID NO: 844305 - protein, 129 aa, Homo sapiens; identical to SEQ ID NO: 844302

SEQ ID NO: 844306 - protein, 129 aa, Homo sapiens; identical to SEQ ID NO: 844302

SEQ ID NO: 844307 - protein, 103 aa, Homo sapiens
MAKSLRSKWKRKMRAEKRKKNAPKEASRLKSILKLDGDVLMKDVQEIATVVVPKPKHCQEKMQCEVKDEKDDMKMETDIKRNKKTLLDQHGQYPPPPQKKKFF

SEQ ID NO: 844308 - protein, 102 aa, Homo sapiens
MAKSLRSKWKRKMRAEKRKKNAPKEASRLKSILKLDGDVLMKDVQEIATVVVPKPKHCQEKMQCEVKDEKEKKKKKKNFVGGLGPGKEFYRDPFRVGAPRGA

SEQ ID NO: 844309 - protein, 413 aa, Homo sapiens
DGSHILTVGVGANIFMYGRLSGIVTEQTNSKDGVAVITLPLGGSIKQGVKSRWVLLRSIDLVSSVDGTPSLPVSLSWVRDGILVVGMDCEMHVYAQWKHAVKFGDTEADSSNAEEAAMQDHSTFKSNMLARKSVVEGTAISDDVFCSPTVIQDGGLFEAAHVLSPTLPQYHPTQLLELMDLGKVRRAKAILSHLVKCIAGEVAIVRDPDAGEGTKRHLSRTISVSGSTAKETVTVGKDGTRDYTEIDSIPPLPLYALLAADQDTSYRISEESTKIPQSYEDQTVSQPEDQYSELFQIQDIPTDDIDLEPEKRENKSKVINLSQYGPAYFGQEHARVLSSHLMHSSLPGLTRLEQMFLVALADTVATTSTELDESRDKSCSGRDTLDECGLRYLLAMRLHTCLLTSLPPLYRVQ

SEQ ID NO: 844310 - protein, 124 aa, Homo sapiens
STGLVHRDNNTFNTLCSAPEELNTECLEQETGERSCSLLRLHKTEDMKRGNMHECPHGEPPPPAAPALMITPIINWGMALCLVLALHGPRTLHRTQRGTRKEEAIRLGTHVLEAHSLDKVSHTL

SEQ ID NO: 844311 - protein, 72 aa, Homo sapiens
HKHVDVLLLCLSEVNLYDVFKKWIIEKVNELMKNESKEKKGGNNAGSEIEVKVNGVMEETANRGNANTAMVQ

SEQ ID NO: 844312 - protein, 110 aa, Homo sapiens
MCLSFYVHHVRKADCIHGYETVGLCWTMKTSPKYVKTDKRRPPFIFFKVKALKERCNRRPPWSVNYFMRDHPSRKCSQVQWLMPVIPALWEVEAGGSLEVRRYRPAWQTR

SEQ ID NO: 844313 - protein, 1246 aa, Homo sapiens
MPAPGALILLAAVSASGCLASPAHPDGFALGRAPLAPPYAVVLISCSGLLAFIFLLLTCLCCKRGDVGFKEFENPEGEDCSGEYTPPAEETSSSQSLPDVYILPLAEVSLPMPAPQPSHSDMTTPLGLSRQHLSYLQEIGSGWFGKVILGEIFSDYTPAQVVVKELRASAGPLEQRKFISEAQPYRSLQHPNVLQCLGLCVETLPFLLIMEFCQLGDLKRYLRAQRPPEGLSPELPPRDLRTLQRMGLEIARGLAHLHSHNYVHSDLALRNCLLTSDLTVRIGDYGLAHSNYKEDYYLTPERLWIPLRWAAPELLGELHGTFMVVDQSRESNIWSLGVTLWELFEFGAQPYRHLSDEEVLAFVVRQQHVKLARPRLKLPYADYWYDILQSCWRPPAQRPSASDLQLQLTYLLSERPPRPPPPPPPPRDGPFPWPWPPAHSAPRPGTLSSPFPLLDGFPGADPDDVLTVTESSRGLNLECLWEKARRGAGRGGGAPAWQPASAPPAPHANPSNPFYEALSTPSVLPVISARSPSVSSEYYIRLEEHGSPPEPLFPNDWDPLDPGVPAPQAPQAPSEVPQLVSETWASPLFPAPRPFPAQSSASGSFLLSGWDPEGRGAGETLAGDPAEVLGERGTAPWVEEEEEEEEGSSPGEDSSSLGGGPSRRGPLPCPLCSREGACSCLPLERGDAVAGWGGHPALGCPHPPEDDSSLRAERGSLADLPMAPPASAPPEFLDPLMGAAAPQYPGRGPPPAPPPPPPPPRAPADPAASPDPPSAVASPGSGLSSPGPKPGDSGYETETPFSPEGAFPGGGAAEEEGVPRPRAPPEPPDPGAPRPPPDPGPLPLPGPREKPTFVVQVSTEQLLMSLREDVTRNLLGEKGATARETGPRKAGRGPGNREKVPGLNRDPTVLGNGKQAPSLSLPVNGVTVLENGDQRAPGIEEKAAENGALGSPEREEKVLENGELTPPRREEKALENGELRSPEAGEKVLVNGGLTPPKSEDKVSENGGLRFPRNTERPPETGPWRAPGPWEKTPESWGPAPTIGEPAPETSLERAPAPSAVVSSRNGGETAPGPLGPAPKNGTLEPGTERRAPETGGAPRAPGAGRLDLGSGGRAPVGTGTAPGGGPGSGVDAKAGWVDNTRPQPPPPPLPPPPEAQPRRLEPAPPRARPEVAPEGEPGAPDSRAGGDTALSGDGDPPKPERKGPEMPRLFLDLGPPQGNSEQIKGEEAAGHSQGRGPAVSEACGG

SEQ ID NO: 844314 - protein, 1131 aa, Homo sapiens
VCVTARETRHHLHLPAILDKMPAPGALILLAAVSASGCLASPAHPDGFALGRAPLAPPYAVVLISCSGLLAFIFLLLTCLCCKRGDVGFKEFENPEGEDCSGEYTPPAEETSSSQSLPDVYILPLAEVSLPMPAPQPSHSDMTTPLGLSRQHLSYLQEIGSGWFGKVILGEIFSDYTPAQVVVKELRASAGPLEQRKFISEAQPYRSLQHPNVLQCLGLCVETLPFLLIMEFCQLGDLKRYLRAQRPPEGLSPELPPRDLRTLQRMGLEIARGLAHLHSHNYVHSDLALRNCLLTSDLTVRIGDYGLAHSNYKEDYYLTPERLWIPLRWAAPELLGELHGTFMVVDQSRESNIWSLGVTLWELFEFGAQPYRHLSDEEVLAFVVRQQHVKLARPRLKLPYADYWYDILQSCWRPPAQRPSASDLQLQLTYLLSERPPRPPPPPPPPRDGPFPWPWPPAHSAPRPGTLSSPFPLLDGFPGADPDDVLTVTESSRGLNLECLWEKARRGAGRGGGAPAWQPASAPPAPHANPSNPFYEALSTPSVLPVISARSPSVSSEYYIRLEEHGSPPEPLFPNDWDPLDPGVPAPQAPQAPSEVPQLVSETWASPLFPAPRPFPAQSSASGSFLLSGWDPEGRGAGETLAGDPAEVLGERGTAPWVEEEEEEEEGSSPGEDSSSLGGGPSRRGPLPCPLCSREGACSCLPLERGDAVAGWGGHPALGCPHPPEDDSSLRAERGSLADLPMAPPASAPPEFLDPLMGAAAPQYPGRGPPPAPPPPPPPPRAPADPAASPDPPSAVASPGSGLSSPGPKPGDSGYETETPFSPEGAFPGGGAAEEEGVPRPRAPPEPPDPGAPRPPPDPGPLPLPGPREKPTFVVQVSTEQLLMSLREDVTRNLLGEKGATARETGPRKAGRGPGNREKVPGLNRDPTVLGNGKQAPSLSLPVNGVTVLENGDQRAPGIEEKAAENGALGSPEREEKVLENGELTPPRREEKALENGELRSPEAGEKVLVNGGLTPPKSEDKVSENGGLRFPRNTERPPETGPWRAPGPWEKTPESWGPAPTIGEPAPETSLERAPAPSAVVSSRNGGETAPGPLGPAPKNGTLEPGTERRPNEAGIPPPLHREPPFSELN

SEQ ID NO: 844315 - protein, 120 aa, Homo sapiens
LGPQPSPVPTDGFALGRAPLAPPYAVVLISCSGLLAFIFLLLTCLCCKRGDVGFKVRCMRGFNLGRKTPARPLPPTQVVGGEKGAVNPRAPSSLKLWQDLEPWDGEMGDGNWAGTGRQLQ

SEQ ID NO: 844316 - protein, 1480 aa, Homo sapiens
VCVTARETRHHLHLPAILDKMPAPGALILLAAVSASGCLASPAHPDGFALGRAPLAPPYAVVLISCSGLLAFIFLLLTCLCCKRGDVGFKEFENPEGEDCSGEYTPPAEETSSSQSLPDVYILPLAEVSLPMPAPQPSHSDMTTPLGLSRQHLSYLQEIGSGWFGKVILGEIFSDYTPAQVVVKELRASAGPLEQRKFISEAQPYRSLQHPNVLQCLGLCVETLPFLLIMEFCQLGDLKRYLRAQRPPEGLSPELPPRDLRTLQRMGLEIARGLAHLHSHNYVHSDLALRNCLLTSDLTVRIGDYGLAHSNYKEDYYLTPERLWIPLRWAAPELLGELHGTFMVVDQSRESNIWSLGVTLWELFEFGAQPYRHLSDEEVLAFVVRQQHVKLARPRLKLPYADYWYDILQSCWRPPAQRPSASDLQLQLTYLLSERPPRPPPPPPPPRDGPFPWPWPPAHSAPRPGTLSSPFPLLDGFPGADPDDVLTVTESSRGLNLECLWEKARRGAGRGGGAPAWQPASAPPAPHANPSNPFYEALSTPSVLPVISARSPSVSSEYYIRLEEHGSPPEPLFPNDWDPLDPGVPAPQAPQAPSEVPQLVSETWASPLFPAPRPFPAQSSASGSFLLSGWDPEGRGAGETLAGDPAEVLGERGTAPWVEEEEEEEEGSSPGEDSSSLGGGPSRRGPLPCPLCSREGACSCLPLERGDAVAGWGGHPALGCPHPPEDDSSLRAERGSLADLPMAPPASAPPEFLDPLMGAAAPQYPGRGPPPAPPPPPPPPRAPADPAASPDPPSAVASPGSGLSSPGPKPGDSGYETETPFSPEGAFPGGGAAEEEGVPRPRAPPEPPDPGAPRPPPDPGPLPLPGPREKPTFVVQVSTEQLLMSLREDVTRNLLGEKGATARETGPRKAGRGPGNREKVPGLNRDPTVLGNGKQAPSLSLPVNGVTVLENGDQRAPGIEEKAAENGALGSPEREEKVLENGELTPPRREEKALENGELRSPEAGEKVLVNGGLTPPKSEDKVSENGGLRFPRNTERPPETGPWRAPGPWEKTPESWGPAPTIGEPAPETSLERAPAPSAVVSSRNGGETAPGPLGPAPKNGTLEPGTERRAPETGGAPRAPGAGRLDLGSGGRAPVGTGTAPGGGPGSGVDAKAGWVDNTRPQPPPPPLPPPPEAQPRRLEPAPPRARPEVAPEGEPGAPDSRAGGDTALSGDGDPPKPERKGPEMPRLFLDLGPPQGNSEQIKARLSRLSLALPPLTLTPFPGPGPRRPPWEGADAGAAGGEAGGAGAPGPAEEDGEDEDEDEEEDEEAAAPGAAAGPRGPGRARAAPVPVVVSSADADAARPLRGLLKSPRGADEPEDSELERKRKMVSFHGDVTVYLFDQETPTNELSVQAPPEGDTDPSTPPAPPTPPHPATPGDGFPSNDSGFGGSFEWAEDFPLLPPPGPPLCFSRFSVSPALETPGPPARAPDARPAGPVEN

SEQ ID NO: 844317 - protein, 174 aa, Homo sapiens
VCVTARETRHHLHLPAILDKMPAPGALILLAAVSASGCLASPAHPDGFALGRAPLAPPYAVVLISCSGLLAFIFLLLTCLCCKRGDVGFKEFENPEGEDCSGEYTPPAEETSSSQSLPDVYILPLAEVSLPMPAPQPSHSDMTTPLGLSRQHLSYLQEIGSGWFGKSAPPSSLH

SEQ ID NO: 844318 - protein, 776 aa, Homo sapiens
AKIKDSMPLLEKNEPKMSEAKNYLSSILNHGRLSPQYMCEAMLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 844319 - protein, 748 aa, Homo sapiens
MSLSFQPQYMCEAMLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 844320 - protein, 776 aa, Homo sapiens; identical to SEQ ID NO: 844318

SEQ ID NO: 844321 - protein, 776 aa, Homo sapiens; identical to SEQ ID NO: 844318

SEQ ID NO: 844322 - protein, 305 aa, Homo sapiens
AKIKDSMPLLEKNEPKMSEAKNYLSSILNHGRLSPQYMCEAMLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRSITSALGRSTSSLRP

SEQ ID NO: 844323 - protein, 105 aa, Homo sapiens
QQRWGETEAHRESKRSRGMAEAAALMALCFLRVREVSMWSRPGGAGSPGESGPLLGCADGHSPSPQPDVHQGEAGAGAERPRGSPRDLQTSAEAVADPVQLLPAG

SEQ ID NO: 844324 - protein, 708 aa, Homo sapiens
SFQHASGFLGEHSPGGQRSCRGGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 844325 - protein, 735 aa, Homo sapiens
MLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 844326 - protein, 737 aa, Homo sapiens
AKIKDSMPLLEKNEPKMSEAKNYLSSILNHGRLSPQYMCEAMLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFKGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 844327 - protein, 776 aa, Homo sapiens; identical to SEQ ID NO: 844318

SEQ ID NO: 844328 - protein, 181 aa, Homo sapiens
MGYRDPRRSRTRGELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 844329 - protein, 776 aa, Homo sapiens; identical to SEQ ID NO: 844318

SEQ ID NO: 844330 - protein, 195 aa, Homo sapiens
LFLPSLAPHNAPTNNTVTTGLIDGAVVSGIGSGERFFPPPSGLSYSSWFCIEHFSSPPNNHPVRLLTVVRRANSSEQHYVCLAIVLSAKDRSLIVSTKEELLQNYVDDFSEESSFYEILPCCARFRCGELIIEGQWHHLVLVMSKGMLKNSTAALYIDGQLVNTVKPSLMSTRLVGILGTFWGYRAFPFRKFQPR

SEQ ID NO: 844331 - protein, 181 aa, Homo sapiens
LFLPSLAPHNAPTNNTVTTGLIDGAVVSGIGSGERFFPPPSGLSYSSWFCIEHFSSPPNNHPVRLLTVVRRANSSEQHYVCLAIVLSAKDRSLIVSTKEELLQNYVDDFSEESSFYEILPCCARFRCGELIIEGQWHHLVLVMSKGMLKNSTAALYIDGQLVNTVKLHYVHSTPGGSGSAN

SEQ ID NO: 844332 - protein, 343 aa, Homo sapiens
MDNQAERESEAGVGLQRDEDDAPLCEDVELQDGDLSPEEKIFLREFPRLKEDLKGNIDKLRALADDIDKTHKKFTKANMVATSTAVISGVMSLLGLALAPATGGGSLLLSTAGQGLATAAGVTSIVSGTLERSKNKEAQARAEDILPTYDQEDREDEEEKADYVTAAGKIIYNLRNTLKYAKKNVRAFWKLRANPRLANATKRLLTTGQVSSRSRVQVQKAFAGTTLAMTKNARVLGGVMSAFSLGYDLATLSKEWKHLKEGARTKFAEELRAKALELERKLTELTQLYKSLQQKVRSRARGVGKDLTGTCETEAYWKELREHVWMWLWLCVCLCVCVYVQFT

SEQ ID NO: 844333 - protein, 343 aa, Homo sapiens; identical to SEQ ID NO: 844332

SEQ ID NO: 844334 - protein, 222 aa, Homo sapiens
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 844335 - protein, 159 aa, Homo sapiens
AGQRLPRVGTRPRDIHGARVTRGRESSVLLEPMPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYGST

SEQ ID NO: 844336 - protein, 254 aa, Homo sapiens
AGQRLPRVGTRPRDIHGARVTRGRESSVLLEPMPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 844337 - protein, 112 aa, Homo sapiens
MTATWLKTARNSTAAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 844338 - protein, 159 aa, Homo sapiens; identical to SEQ ID NO: 844335

SEQ ID NO: 844339 - protein, 106 aa, Homo sapiens
AGQRLPRVGTRPRDIHGARVTRGRESSVLLEPMPKTMHFLFRFIVFFYLWGLFTAQRQKKEESTEEVKIEVLHRPENCSKTSKKGDLLNAHYDGYLAKDGSKFYCR

SEQ ID NO: 844340 - protein, 173 aa, Homo sapiens
RECLNQEREVAVSRDRTTVLRLGDRTRLRLKKKKKLETSSLSLVRNSARAMTDMCPGEKRKVVIPPSFAYGKEGYAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 844341 - protein, 159 aa, Homo sapiens; identical to SEQ ID NO: 844335

SEQ ID NO: 844342 - protein, 254 aa, Homo sapiens; identical to SEQ ID NO: 844336

SEQ ID NO: 844343 - protein, 238 aa, Homo sapiens
VWLCGGSMEVLPCSRVAHIERKKKPYNSNIGFYTKRNALRVAEVWMDDYKSHVYIAWNLPLENPGIDIGDVSERRALRKSLKCKNFQWYLDHVYPEMRRYNNTVAYGELRNNKAKDVCLDQGPLENHTAILYPCHGWGPQLARYTKEGFLHLGALGTTTLLPDTRCLVDNSKSRLPQLLDCDKVKSSLYKRWNFIQNGAIMNKGTGRCLEVENRGLAGIDLILRSCTGQRWTIKNSIK

SEQ ID NO: 844344 - protein, 108 aa, Homo sapiens
LHICPHIMGATRPLHTPSALGISLRLRKSKAPPTPIALLLHQRSCKDASRDQPPAQASKAGAPLRGRMARVAPGSLWKGRHQPCPTLRGALYAYKAPQDGAGSRTREP

SEQ ID NO: 844345 - protein, 139 aa, Homo sapiens
SERRRWRPKMASWLPETLFETVGQGPPPSKDYYQLLVTRSQVIFRWWKISLRSEYRSTKPGEAKETHEDFLENSHLQGQTALIFGARILDYVINLCKGKFDFLERLSDDLLLTIISYLDLEDIARLCQTSHRFAKTESC

SEQ ID NO: 844346 - protein, 157 aa, Homo sapiens
MVIFRWWKISLRSEYRSTKPGEAKETHEDFLENSHLQGQTALIFGARILDYVINLCKGKFDFLERLSDDLLLTIISYLDLEDIARLCQTSHRFAKLCMSDKLWEQIVQSTCDTITPDVRALAEDTGWRQLFFTNKLQLQRQLRKRKQKYGNLREKQP

SEQ ID NO: 844347 - protein, 197 aa, Homo sapiens
SERRRWRPKMASWLPETLFETVGQGPPPSKDYYQLLVTRSQVIFRWWKISLRSEYRSTKPGEAKETHEDFLENSHLQGQTALIFGARILDYVINLCKGKFDFLERLSDDLLLTIISYLDLEDIARLCQTSHRFAKLCMSDKLWEQIVQSTCDTITPDVRALAEDTGWRQLFFTNKLQLQRQLRKRKQKYGNLREKQP

SEQ ID NO: 844348 - protein, 197 aa, Homo sapiens; identical to SEQ ID NO: 844347

SEQ ID NO: 844349 - protein, 157 aa, Homo sapiens; identical to SEQ ID NO: 844346

SEQ ID NO: 844350 - protein, 98 aa, Homo sapiens
SERRRWRPKMASWLPETLFETVGQGPPPSKDYYQLLVTRSQVIFRWWKISLRSEYRSTKPGEAKETHEDFLENSHLQGKERNILYTPVKFSLVSGRFC

SEQ ID NO: 844351 - protein, 197 aa, Homo sapiens; identical to SEQ ID NO: 844347

SEQ ID NO: 844352 - protein, 193 aa, Homo sapiens
MALSWVLTVLSLLPLLEAQIPLCANLVPVPITNATLDRITGKWFYIASAFRNEEYNKSVQEIQATFFYFTPNKTEDTIFLQRVTKTRQDPVASINTTLPGNVPSGKMGTHLPRYRGEGPRACSPHLPDPSGTPKTLHACFLTVNDEKNWGLSVYADKPETTKEQLGEFYEALRDCLRISQVRCRVHRLAHTHG

SEQ ID NO: 844353 - protein, 149 aa, Homo sapiens
RFFEKKKNRPSQYALSGSSSLSSYLAESQFHCVQPSPGAITNATLTRSLASGFISHRPFETRSTISRFRRSKQPSFTSPPTRQRTRSFFRELPGPDRTQLHLLTPPYLGMFPAGKWGPISPDTVGRAQEHVRLTCLIPQGHPRPYMLAS

SEQ ID NO: 844354 - protein, 113 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTRYVGRAQEHVRLTCLIPQGHPRPYMLAS

SEQ ID NO: 844355 - protein, 193 aa, Homo sapiens; identical to SEQ ID NO: 844352

SEQ ID NO: 844356 - protein, 193 aa, Homo sapiens; identical to SEQ ID NO: 844352

SEQ ID NO: 844357 - protein, 230 aa, Homo sapiens
MALSWVLTVLSLLPLLEAQIPLCANLVPVPITNATLDRITGKWFYIASAFRNEEYNKSVQEIQATFFYFTPNKTEDTIFLQRVTKTRQDPVASINTTLPGNVPSGKMGTHLPRYRGEGPRACSPHLPDPSGTPKTLHACFLTVNDEKNWGLSVYADKPETTKEQLGEFYEALRDCLRISQVRCRVHRLAHTHAGKSVPDTGWEQGRELGGHGCAGGGHVDLNVFPSVRIG

SEQ ID NO: 844358 - protein, 225 aa, Homo sapiens
MALSWVLTVLSLLPLLEAQIPLCANLVPVPITNATLDRITGKWFYIASAFRNEEYNKSVQEIQATFFYFTPNKTEDTIFLQRVTKTRQDPVASINTTLPGNVPSGKMGTHLPRYRGEGPRACSPHLPDPSGTPKTLHACFLTVNDEKNWGLSVYADKPETTKEQLGEFYEALRDCLRISQVRCRVHRLAHTHGKRKGLDSAHLVHGPTWAAPEAQSRRAARQGCT

SEQ ID NO: 844359 - protein, 224 aa, Homo sapiens
MIGSTCVLSLVIEHVSVVCYTSVNPWYTHVCELPYFTLVDNASGSARCAMLLKAQSWMRRFMWAQLACESIKSGSSQKTQDVRIIIMYGLGTIQATFFYFTPNKTEDTIFLQRVTKTRQDPVASINTTLPGNVPSGKMGTHLPRYRGEGPRACSPHLPDPSGTPKTLHACFLTVNDEKNWGLSVYADKPETTKEQLGEFYEALRDCLRISQVRCRVHRLAHTHG

SEQ ID NO: 844360 - protein, 119 aa, Homo sapiens
MALSWVLTVLSLLPLLEAQIPLCANLVPVPITNATLDRITGKWFYIASAFRNEEYNKSVQEIQATFFYFTPNKTEDTIFLQRVTKTRQDPVASINTTLPGNVPSGLIPQGHPRPYMLAS

SEQ ID NO: 844361 - protein, 122 aa, Homo sapiens
MALSWVLTVLSLLPLLEAQIPLCANLVPVPITNATLDRITGKWFYIASAFRNEEYNKSVQEIQATFFYFTPNKTEDTIFLREYQTRQNQCFYNSSYLNVQRENGTVSRYEGGREHVRSPAVP

SEQ ID NO: 844362 - protein, 123 aa, Homo sapiens
MALSWVLTVLSLLPLLEAQIPLCANLVPVPITNATLDRITGKWFYIASAFRNEEYNKSVQEIQATFFYFTPNKTEDTIFLQRVTKTRQNQCFYNSSYLNVQRENGTVSRYEGGREHVRSPAVP

SEQ ID NO: 844363 - protein, 124 aa, Homo sapiens
MALSWVLTVLSLLPLLEAQIPLCANLVPVPITNATLDRITGKWFYIASAFRNEEYNKSVQEIQATFFYFTPNKTEDTIFLQRVTKTRQNQCFYNTTYLSELSIRVYQNTPFQGMYALLFLSCLH

SEQ ID NO: 844364 - protein, 104 aa, Homo sapiens
MALSWVLTVLSLLPLLEAQIPLCANLVPVPITNATLDRITGKWFYIASAFRNEEYNKSVQEIQATFFYFTPNKTEDTIFLREYQTRGRPRTCSLTCCSLGTPRP

SEQ ID NO: 844365 - protein, 130 aa, Homo sapiens
MALSWVLTVLSLLPLLEAQIPLCANLVPVPITNATLDRHQFIKFDTEEEAIAIANAADVGLAGYFYSQDPAQIWRVAEQLEVGMVGVNEGLISSVEALLVAVKQSGLGREGSKYGIDEYLELKYVCYGGL

SEQ ID NO: 844366 - protein, 193 aa, Homo sapiens; identical to SEQ ID NO: 844352

SEQ ID NO: 844367 - protein, 193 aa, Homo sapiens; identical to SEQ ID NO: 844352

SEQ ID NO: 844368 - protein, 192 aa, Homo sapiens
CLSCCLVKKGLASSLPSTMIVSFLRPPSHVSSEACGTITGKWFYIASAFRNEEYNKSVQEIQATFFYFTPNKTEDTIFLQRVTKTRQDPVASINTTLPGNVPSGKMGTHLPRYRGEGPRACSPHLPDPSGTPKTLHACFLTVNDEKNWGLSVYADKPETTKEQLGEFYEALRDCLRISQVRCRVHRLAHTHG

SEQ ID NO: 844369 - protein, 193 aa, Homo sapiens; identical to SEQ ID NO: 844352

SEQ ID NO: 844370 - protein, 195 aa, Homo sapiens
MEQAKVALEAFCKTSPGRQASVSLCANLVPVPITNATLDRITGKWFYIASAFRNEEYNKSVQEIQATFFYFTPNKTEDTIFLQRVTKTRQDPVASINTTLPGNVPSGKMGTHLPRYRGEGPRACSPHLPDPSGTPKTLHACFLTVNDEKNWGLSVYADKPETTKEQLGEFYEALRDCLRISQVRCRVHRLAHTHG

SEQ ID NO: 844371 - protein, 218 aa, Homo sapiens
MALSWVLTVLSLLPLLEAQIPLCANLVPVPITNATLDRITGKWFYIASAFRNEEYNKSVQEIQATFFYFTPNKTEDTIFLQRVTKTRQDPVASINTTLPGNVPSGKMGTHLPRYRGEGPRACSPHLPDPSGTPKTLHACFLTVNDEKNWGLSVYADKPETTKEQLGEFYEALRDCLRISQVRCRVHRLAHTHGCQRDTGVGSDRRLGGGPGGGGREVR

SEQ ID NO: 844372 - protein, 200 aa, Homo sapiens
MALSWVLTVLSLLPLLEAQIPLCANLVPVPITNATLDRITGKWFYIASAFRNEEYNKSVQEIQATFFYFTPNKTEDTIFLQRVTKTRQDPVASINTTLPGNVPSGKMGTHLPRYRGEGPRACSPHLPDPSGTPKTLHACFLTVNDEKNWGLSVYADKPETTKEQLGEFYEALRDCLQWLTLILFPTVYTTSDLGMRNGRG

SEQ ID NO: 844373 - protein, 123 aa, Homo sapiens; identical to SEQ ID NO: 844362

SEQ ID NO: 844374 - protein, 252 aa, Homo sapiens
MALSWVLTVLSLLPLLEAQIPLCANLVPVPITNATLDRITGKWFYIASAFRNEEYNKSVQEIQATFFYFTPNKTEDTIFLQRVTKTRGEGPRACSPHLPDPSGTPKTLHACFLTVNDEKNWGLSVYADKPETTKEQLGEFYEALRDCLRISQVRCRVHRLAHTHGLTCEPLEKQHEKERKHGSGEQSKRRERLLAKYLSIQLSNNSPPNMIGSTAVDYSIASTSSGLALDPTWARQKGRSSLQPEPRCYRHG

SEQ ID NO: 844375 - protein, 104 aa, Homo sapiens
MALSWVLTVLSLLPLLEAQIPLCANLVPVPITNATLDRITGKWFYIASAFRNEEYNKSVQEIQATFFYFTPNKTEDTIFLQRVTKTRETDKDTRCIYKKNINMK

SEQ ID NO: 844376 - protein, 325 aa, Homo sapiens
MGDTAPPQAPAGGLGGASGAGLLGGGSVTPRVHSAIVERLRARIAVCRQHHLSCEGRYERGRAESSDRERESTLQLLSLVQHGQGARKAGKHTKATATAATTTAPPPPPAAPPAASQAAATAAPPPPPDYHHHHQQHLLNSSNNGGSGGINGEQQPPASTPGDQRNSALIAVSTWLSHGSGCGPVTFCEGRVCFGLKVEWMAMKKAKMSPDYLKGHWVCSGGFMRLLIMFCWCSLLGFPSLIGYSLTDKKPEFSRGSLGSTSYKRRGYQLARSEPLRKVLSHGSSSFGQPALIRPPSHFSAPKHLSAQLAFIKAFFSLPHFPSPF

SEQ ID NO: 844377 - protein, 1153 aa, Homo sapiens [sequence omitted]

SEQ ID NO: 844378 - protein, 110 aa, Homo sapiens
LVDDLDAYFVSEDETITAVCKEPTRPKFKMPEMNIKAPKIPMPDFDLHLKGTHGRGFLAEEACTQESQSTGSIVRFSFLEITCTYSHTRNEHTYRQGKPQTVIQVGRRKI

SEQ ID NO: 844379 - protein, 770 aa, Homo sapiens
DVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADVDISGPKVDIEGPDVNIEGPEGKLKGPKLKMPEMNIKAPKISMPDFDLHLKGPKVKGDVDVSLPKVEGDLKGPEVDIKGPKVDINAPDVGVQGPDWHLKMPKVKMPKFSMPGFKGEGPDGDVKLPKADIDVSGPKVDIEGPDVNIEGPEGKLKGPKFKMPEMNIKAPKISMPDIDLNLKGPKVKGDVDVSLPKVEGDLKGPEVDIKGPKVDIDAPDVDVHGPDWHLKMPKIKMPKISMPGFKGEGPDVDVNLPKADIDVSGPKVDVECPDVNIEGPEGKWKSPKFKMPEMHFKTPKISMPDIDLNLTGPKIKGDVDVTGPKVEGDLKGPEVDLKGPKVDIDVPDVNVQGPDWHLKMPKMKMPKFSMPGFKAEGPEVDVNLPKADVDVSGPKVDVEGPDVNIEGPEGKLKGPKFKMPEMNIKAPKIPMPDFDLHLKGTHGRGFLAEEACTQESQSTGSIVRFSFLEITCTYSHTRNEHTYRQGKPQTVIQVGRRKI

SEQ ID NO: 844380 - protein, 514 aa, Homo sapiens
DVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADIDVSGPKVDVECPDVNIEGPEGKWKSPKFKMPEMHFKTPKISMPDIDLNLTGPKIKGDVDVTGPKVEGDLKGPEVDLKGPKVDIDVPDVNVQGPDWHLKMPKMKMPKFSMPGFKAEGPEVDVNLPKADVDVSGPKVDVEGPDVNIEGPEGKLKGPKFKMPEMNIKAPKIPMPDFDLHLKGTHGRGFLAEEACTQESQSTGSIVRFSFLEITCTYSHTRNEHTYRQGKPQTVIQVGRRKI

SEQ ID NO: 844381 - protein, 108 aa, Homo sapiens
VELECPDAKLKGPKFKMPDMHFKAPKISMPDVDLHLKGPKVKGDVDVSVPKLEGDLTGPSVGVEVPDVELECPDAKLKGPKFKMPEMHFKTPKSKGMWMCLCQNWREI

SEQ ID NO: 844382 - protein, 68 aa, Homo sapiens
VELECPDAKLKGPKFKMPDMHFKAPKISMPDVDLHLKGPKVKGDVDVSVPKLEGDLTGPSVGVEVPDE

SEQ ID NO: 844383 - protein, 563 aa, Homo sapiens
DVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADVDISGPKVDIEGPDVNIEGPEGKLKGPKLKMPEMNIKAPKISMPDFDLHLKGPKVKGDVDVSLPKVEGDLKGPEVDIKGPKVDINAPDVGVQGPDWHLKMPKVKMPKFSMPGFKGEGPDGDVKLPKADIDVSGPKVDIEGPDVNIEGPEGKLKGPKFKMPEMNIKAPKISMPDIDLNLKGPKVKGDVDVSLPKVEGDLKGPEVDIKGPKVDIDAPDVDVHGPDWHLKMPKIKMPKISMPGFKGEGPDVDVNLPKADIDVSGPKVDVECPDVNIEGPELLEPIPYEFMA

SEQ ID NO: 844384 - protein, 284 aa, Homo sapiens
VELECPDAKLKGPKFKMPDMHFKAPKISMPDVDLHLKGPKVKGDVDVSVPKLEGDLTGPSVGVEVPDVELECPDAKLKGPKFKMPEMHFKTPKISMPDVDLHLKGPKVKGDMDVSVPKVEGEMKVPDVDIKGPKMDIDAPDVDVHGPDWHLKMPKMKMPKFSMPGFKAEGPEVDVNLPKADVVVSGPKVDVEVPDVSLEGPEGKLKGPKLKMPEMHFKAPKISMPDVDLHLKGPKVKGDVDVSLPKLEGDLTGPSVDVEVPDVELECPDAKLKGPKFKMPEMHF

SEQ ID NO: 844385 - protein, 175 aa, Homo sapiens
MVEGDLKGPEVDLKGPKVDIDVPDVNVQGPDWHLKMPKMKMPKFSMPGFKAEGPEVDVNLPKADVDVSGPKVDVEGPDVNIEGPEGKLKGPKFKMPEMNIKAPKIPMPDFDLHLKGTHGRGFLAEEACTQESQSTGSIVRFSFLEITCTYSHTRNEHTYRQGKPQTVIQVGRRKI

SEQ ID NO: 844386 - protein, 74 aa, Homo sapiens
FLRLGGRRLCAGLQVLPRIGVIAEPDALEGWAWGPQSTPEAFPLGRVASRRRKHSHVKDELPIKATLLSSRTES

SEQ ID NO: 844387 - protein, 74 aa, Homo sapiens; identical to SEQ ID NO: 844386

SEQ ID NO: 844388 - protein, 161 aa, Homo sapiens
MLFSIRSAKFVFKELFQFIPSTAIGIMSGRGKGGKGLGKGGAKRHRKVLRDNIQGITKPAIRRLARRGGVKRISGLIYEETRGVLKVFLENVIRDAVTYTEHAKRKTVHSHGCSICPKTFRGALCMASAAESKNTRSPENFKKQKKPKGPFQGRSQSRLKS

SEQ ID NO: 844389 - protein, 195 aa, Homo sapiens
MLFSIRSAKFVFKELFQFIPSTAIGIMSGRGKGGKGLGKGGAKRHRKVLRDNIQGITKPAIRRLARRGGVKRISGLIYEETRGVLKVFLENVIRDAVTYTEHAKRKTVHSHGCSICPKTFRGALCMASAAESKNTRSPENFKKQKKKAAARFESVIDTVDSGARYHSPKVIVLNSWASFVVMGLALPYRLHSPFA

SEQ ID NO: 844390 - protein, 144 aa, Homo sapiens
MLFSIRSAKFVFKELFQFIPSTAIGIMSGRGKGGKGLGKGGAKRHRKVLRDNIQGITKPAIRRLARRGGVKRISGLIYEETRGVLKVFLENVIRDAVTYTEHAKRKTVHSHGCSICPKTFRGALCMASAAESKNTRSPENFKKQ

SEQ ID NO: 844391 - protein, 180 aa, Homo sapiens
QAKLVTPGPITLNDAHDCNTTRPQANGYRPPFEFDVIASACYRIRGRATAARRRQKGTAIGIMSGRGKGGKGLGKGGAKRHRKVLRDNIQGITKPAIRRLARRGGVKRISGLIYEETRGVLKVFLENVIRDAVTYTEHAKRKTVHSHGCSICPKTFRGALCMASAAESKNTRSPENFKKQ

SEQ ID NO: 844392 - protein, 197 aa, Homo sapiens
QAKLVTPGPITLNDAHDCNTTRPQANGYRPPFEFDVIASACYRIRGRATAARRRQKGTAIGIMSGRGKGGKGLGKGGAKRHRKVLRDNIQGITKPAIRRLARRGGVKRISGLIYEETRGVLKVFLENVIRDAVTYTEHAKRKTVHSHGCSICPKTFRGALCMASAAESKNTRSPENFKKQKKPKGPFQGRSQSRLKS

SEQ ID NO: 844393 - protein, 149 aa, Homo sapiens
QKLSGIPPLPGTRPASDTAARRRQKGTAIGIMSGRGKGGKGLGKGGAKRHRKVLRDNIQGITKPAIRRLARRGGVKRISGLIYEETRGVLKVFLENVIRDAVTYTEHAKRKTVHSHGCSICPKTFRGALCMASAAESKNTRSPENFKKQ

SEQ ID NO: 844394 - protein, 151 aa, Homo sapiens
MLFSIRSAKFVFKELFQFIPSTAIGIMSGRGKGGKGLGKGGAKRHRKVLRDNIQGITKPAIRRLARRGGVKRISGLIYEETRGVLKVFLENVIRDAVTYTEHAKRKTVHSHGCSICPKTFRGALCMASAGLGKKIFPPLFKKKRGGKKKIF

SEQ ID NO: 844395 - protein, 102 aa, Homo sapiens
AKKKSGKGTTTATPTKPAIRRLARRGGVKRISGLIYEETRGVLKVFLENVIRDAVTYTEHAKRKTVHSHGCSICPKTFRGALCMASAAESKNTRSPENFKKQ

SEQ ID NO: 844396 - protein, 216 aa, Homo sapiens
QAKLVTPGPITLNDAHDCNTTRPQANGYRPPFEFDVIASACYRIRGRATAARRRQKGTAIGIMSGRGKGGKGLGKGGAKRHRKVLRDNIQGITKPAIRRLARRGGVKRISGLIYEETRGVLKVFLENVIRDAVTYTEHAKRKTVHSHGCSICPKTFRGALCMASAAESKNTRSPENFKKQKRPSNVDAAANSYQLSLDSGGPYQLPYMIVLQSWRV

SEQ ID NO: 844397 - protein, 204 aa, Homo sapiens
QAKLVTPGPITLNDAHDCNTTRPQANGYRPPFEFDVIASACYRIRGRATAARRRQKGTAIGIMSGRGKGGKGLGKGGAKRHRKVLRDNIQGITKPAIRRLARRGGVKRISGLIYEETRGVLKVFLENVIRDAVTYTEHAKRKTVHSHGCSICPKTFRGALCMASAAESKNTRSPENFKKQILSAVSDQTIVYSSMLMHAAVLRA

SEQ ID NO: 844398 - protein, 147 aa, Homo sapiens
EPAARLRLRERRQKVTAARRRQKGTAIGIMSGRGKGGKGLGKGGAKRHRKVLRDNIQGITKPAIRRLARRGGVKRISGLIYEETRGVLKVFLENVIRDAVTYTEHAKRKTVHSHGCSICPKTFRGALCMASAAESKNTRSPENFKKQ

SEQ ID NO: 844399 - protein, 42 aa, Homo sapiens
GDAEKAADKIRHPFLIKSSKPGRQCYFLKLVINIYLKSTVSI

SEQ ID NO: 844400 - protein, 104 aa, Homo sapiens
MACLRGRPLCCASGWQGSHTWESGCQGEQGWESPCRTLMEWLEGGGQTFNVPLPAFQVRQVWCWVALPCPHPTERASEWAAPFHACTPDIQHRTSFPFLRQGLT

SEQ ID NO: 844401 - protein, 678 aa, Homo sapiens
AGGGGGGGGGRGSFRFALHPGSSSAAGTASSGRLAGFALALRQPGRIMGLPRGPEGQGLPEVETREDEEQNVKLTEILELLVAAGYFRARIKGLSPFDKVVGGMTWCITTCNFDVDVDLLFQENSTIGQKIALSEKIVSVLPRMKCPHQLEPHQIQGMDFIHIFPVVQWLVKRAIETKEEMGDYIRSYSVSQFQKTYSLPEDDDFIKRKEKAIKTVVDLSEVYKPRRKYKRHQGAEELLDEESRIHATLLEYGRRYGFSRQSKMEKAEDKKTALPAGLSATEKADAHEEDELRAAEEQRIQSLMTKMTAMANEESRLTASSVGQIVGLCSAEIKQIVSEYAEKQSELSAEESPEKLGTSQLHRRKVISLNKQIAQKTKHLEELRASHTSLQARYNEAKKTLTELKTYSEKLDKEQAALEKIESKADPSILQNLRALVAMNENLKSQEQEFKAHCREEMTRLQQEIENLKAERAPRGDEKTLSSGEPPGTLTSAMTHDEDLDRRYNMEKEKLYKIRLLQARRNREIAILHRKIDEVPSRAELIQYQKRFIELYRQISAVHKETKQFFTLYNTLDDKKVYLEKEISLLNSIHENFSQAMASPAARDQFLRQMEQIVEGIKQSRMKMEKKKQENKMRRDQLNDQYLELLEKQRLYFKTVKEFKEEGRKNEMLLSKVKAKAS

SEQ ID NO: 844402 - protein, 678 aa, Homo sapiens; identical to SEQ ID NO: 844401

SEQ ID NO: 844403 - protein, 254 aa, Homo sapiens
AGGGGGGGGGRGSFRFALHPGSSSAAGTASSGRLAGFALALRQPGRIMGLPRGPEGQGLPEVETREDEEQNVKLTEILELLVAAGYFRARIKGLSPFDKVVGGMTWCITTCNFDVDVDLLFQENSTIGQKIALSEKIVSVLPRMKCPHQLEPHQIQGMDFIHIFPVVQWLVKRAIETKEEMGDYIRSYSVSQFQKTYSLPEDDDFIKRKEKAIKTVVDLSEVYKPRRKYKRHQGAEELLDEESRIHATLLEYGR

SEQ ID NO: 844404 - protein, 415 aa, Homo sapiens
MEKAEDKKTALPAGLSATEKADAHEEDELRAAEEQRIQSLMTKMTAMANEESRLTASSVGQIVGLCSAEIKQIVSEYAEKQSELSAEESPEKLGTSQLHRRKVISLNKQIAQKTKHLEELRASHTSLQARYNEAKKTLTELKTYSEKLDKEQAALEKIESKADPSILQNLRALVAMNENLKSQEQEFKAHCREEMTRLQQEIENLKAERAPRGDEKTLSSGEPPGTLTSAMTHDEDLDRRYNMEKEKLYKIRLLQARRNREIAILHRKIDEVPSRAELIQYQKRFIELYRQISAVHKETKQFFTLYNTLDDKKVYLEKEISLLNSIHENFSQAMASPAARDQFLRQMEQIVEGIKQSRMKMEKKKQENKMRRDQLNDQYLELLEKQRLYFKTVKEFKEEGRKNEMLLSKVKAKAS

SEQ ID NO: 844405 - protein, 469 aa, Homo sapiens
AGGGGGGGGGRGSFRFALHPGSSSAAGTASSGRLAGFALALRQPGRIMGLPRGPEGQGLPEVETREDEEQNVKLTEILELLVAAGYFRARIKGLSPFDKVVGGMTWCITTCNFDVDVDLLFQENSTIGQKIALSEKIVSVLPRMKCPHQLEPHQIQGMDFIHIFPVVQWLVKRAIETKEEMGDYIRSYSVSQFQKTYSLPEDDDFIKRKEKAIKTVVDLSEVYKPRRKYKRHQGAEELLDEESRIHATLLEYGRRYGFSRQSKMEKAEDKKTALPAGLSATEKADAHEEDELRAAEEQRIQSLMTKMTAMANEESRLTASSVGQIVGLCSAEIKQIVSEYAEKQSELSAEESPEKLGTSQLHRRKVISLNKQIAQKTKHLEELRASHTSLQARYNEAKKTLTELKTYSEKLDKEQAALEKIESKADPSILQNLRALVAMNENLKSQEQEFKAHCRVSVVWCQQINQDAY

SEQ ID NO: 844406 - protein, 110 aa, Homo sapiens
LDITAKIHVGILLLSYMFRTTHCCSLPFLFQQRIQSLMTKMTAMANEEVSGSRGGVGMGTWHHPALLGSSPREPTFSGAASHQHTVPPLPQGVPFVNLFLMPSAATHGNL

SEQ ID NO: 844407 - protein, 38 aa, Homo sapiens
MTLTFWGLISVGGHAHVRPPRAMKAPWVCHKKKYKSMP

SEQ ID NO: 844408 - protein, 100 aa, Homo sapiens
VHKQVVESAYEVIKLKGYTSWAIGLSVADLAESIMKNLRRVHPISTMIGGIKDDVFLSIPCILGENGISDRVKVTLTPEEGAHLKNSADPLWGIQKELQF

SEQ ID NO: 844409 - protein, 338 aa, Homo sapiens
MTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKVSPRTRRQSNRAT

SEQ ID NO: 844410 - protein, 477 aa, Homo sapiens
DFDRGESVLQILLQKAFPLFSQQLQSVNGYVGIPFVCRDSVVKANSKELSPSGQVIRMEFDSSPVGMDSMEANLNESKRQHAELRDKTEKMVHESSNRLYDLPAKRREQQKLQEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKVSPRTRRQSNRAT

SEQ ID NO: 844411 - protein, 338 aa, Homo sapiens; identical to SEQ ID NO: 844409

SEQ ID NO: 844412 - protein, 657 aa, Homo sapiens
MIPCRAALTFARCLIRRKIVTLDSLEDTKLCRCLSTMDLIALGVGSTLGAGVYVLAGEVAKADSGPSIVVSFLIAALASVMAGLCYAEFGARVPKTGSAYLYTYVTVGELWAFITGWNLILSYVIGTSSVARAWSGTFDELLSKQIGQFLRTYFRMNYTGLAEYPDFFAVCLILLLAGLLSFGVKESAWVNKVFTAVNILVLLFVMVAGFVKGNVANWKISEEFLKNISASAREPPSENGTSIYGAGGFMPYGFTGTLAGAATCFYAFVGFDCIATTGEEVRNPQKAIPIGIVTSLLVCFMAYFGVSAALTLMMPYYLLDEKSPLPVAFEYVGWGPAKYVVAAGSLCALSTSLLGSMFPLPRILFAMARDGLLFRFLARVSKRQSPVAATLTAGVISALMAFLFDLKALVDMMSIGTLMAYSLVAACVLILRYQPGLSYDQPKCSPEKDGLGSSPRVTSKSESQVTMLQRQGFSMRTLFCPSLLPTQQSASLVSFLVGFLAFLVLGLSVLTTYGVHAITRLEAWSLALLTLFLVLFVAIVLTIWRQPQNQQKVAFMVPFLPFLPAFSILVNIYLMVQLSADTWVRFSIWMAIGFLIYFSYGIRHSLEGHLRDENNEEDAYPDNVHAAAEEKSAIQANDHHPRNLSSPFIFHEKTSEF

SEQ ID NO: 844413 - protein, 730 aa, Homo sapiens
PSAARPAGAPLPGTSEAAAAAPASPSRGPPTRCSRQPTAAFLARPQPSPTGDSLKTSRKAVSPYRSPSSDVRMIPCRAALTFARCLIRRKIVTLDSLEDTKLCRCLSTMDLIALGVGSTLGAGVYVLAGEVAKADSGPSIVVSFLIAALASVMAGLCYAEFGARVPKTGSAYLYTYVTVGELWAFITGWNLILSYVIGTSSVARAWSGTFDELLSKQIGQFLRTYFRMNYTGLAEYPDFFAVCLILLLAGLLSFGVKESAWVNKVFTAVNILVLLFVMVAGFVKGNVANWKISEEFLKNISASAREPPSENGTSIYGAGGFMPYGFTGTLAGAATCFYAFVGFDCIATTGEEVRNPQKAIPIGIVTSLLVCFMAYFGVSAALTLMMPYYLLDEKSPLPVAFEYVGWGPAKYVVAAGSLCALSTSLLGSIFPMPRVIYAMAEDGLLFKCLAQINSKTKTPIIATLSSGAVAALMAFLFDLKALVDMMSIGTLMAYSLVAACVLILRYQPGLSYDQPKCSPEKDGLGSSPRVTSKSESQVTMLQRQGFSMRTLFCPSLLPTQQSASLVSFLVGFLAFLVLGLSVLTTYGVHAITRLEAWSLALLALFLVLFVAIVLTIWRQPQNQQKVAFMVPFLPFLPAFSILVNIYLMVQLSADTWVRFSIWMAIGFLIYFSYGIRHSLEGHLRDENNEEDAYPDNVHAAAEEKSAIQANDHHPRNLSSPFIFHEKTSEF

SEQ ID NO: 844414 - protein, 730 aa, Homo sapiens; identical to SEQ ID NO: 844413

SEQ ID NO: 844415 - protein, 730 aa, Homo sapiens; identical to SEQ ID NO: 844413

SEQ ID NO: 844416 - protein, 730 aa, Homo sapiens; identical to SEQ ID NO: 844413

SEQ ID NO: 844417 - protein, 730 aa, Homo sapiens; identical to SEQ ID NO: 844413

SEQ ID NO: 844418 - protein, 730 aa, Homo sapiens; identical to SEQ ID NO: 844413

SEQ ID NO: 844419 - protein, 137 aa, Homo sapiens
MYIIFKELINTTTFQGYSLRKVTRRRVFCQSDFPMCLFSFLESHLLKTEQVSMGLVALCLMALRERWLVLQLAFMPLWDLTALQQLVRAVSWLSVEGVFLVVHEYPCVVAEGPGKREGFRVRRALVPGPAVTRAADD

SEQ ID NO: 844420 - protein, 53 aa, Homo sapiens
VRFDSVGGLSNHIAALKEMVVFPLLYPEVFEKFKIQPPRVWLFYGPPGTGNTL

SEQ ID NO: 844421 - protein, 80 aa, Homo sapiens
WGLTIVMLWNKARGGRDGRHLMSLTLQDVQQEEAASCRLTMRASSVISTVLTAIINANRNVQTTQNLRTPISINCSETSI

SEQ ID NO: 844422 - protein, 111 aa, Homo sapiens
WAKDMKFTKEETPRQTHHRKSHSNLAIREKQMKNKMSPYTHETGSGWEAGRVPVWQGRGASCPGGGRCPVLPVRVTEPEPSMPLLDVHPKETLVQTHQGTCLDVTIHTCVG

SEQ ID NO: 844423 - protein, 147 aa, Homo sapiens
MFLNGNCLETLKKKEPEGGRRRLSHPGNMGWMRPSQETTPPDRSHHSGFGLFCGDPGPEIEPFSLWVFPQEMVLEIHQLFMDHEYPCHHITSHCTWVAAHWTTSQSCAAWQGCRRACCSTWWKSPAQCTRPTVMSATFETAQEPGPS

SEQ ID NO: 844424 - protein, 147 aa, Homo sapiens; identical to SEQ ID NO: 844423

SEQ ID NO: 844425 - protein, 83 aa, Homo sapiens
CRILEGTTPQSEAAGGVTVNTIGAESISDEEVAPGQVVVTGHDGVGERTATMSVLEGEASGRDTQTQGHSLIPLFNKYLLVIC

SEQ ID NO: 844426 - protein, 210 aa, Homo sapiens
AAPIQGLRSPERDPGTPRPVGGPCPGLGGAITPSLKTRGYRTQDRGPGGGSAGETARLAQRRGRGPGGPQSTPRNPRVSRGERSHCPTQTVKKLLEEQRRRQQQQPDAGGVQGQFLPPPEQPLTPSVNEAVTGHPPFPAHSETVGSGPSSLGFPDWDPNTHAAYTDSPYSCPASAAENFLPPDFYPPSDPGQPCPFPQGMEVRYRVGTGC

SEQ ID NO: 844427 - protein, 250 aa, Homo sapiens
AAPIQGLRSPERDPGTPRPVGGPCPGLGGAITPSLKTRGYRTQDRGPGGGSAGETARLAQRRGRGPGGPQSTPRNPRVSRGERSHCPTQTVKKLLEEQRRRQQQQPDAGGVQGQFLPPPEQPLTPSVNEAVTGHPPFPAHSETVGSGPSSLGFPDWDPNTHAAYTDSPYSCPASAAENFLPPDFYPPSDPGQPCPFPQGMEAGPWRVSAPPSGPPQFPAVVPGPSLEVARAHMLALGPQQLLAQDEEGDT

SEQ ID NO: 844428 - protein, 258 aa, Homo sapiens
MASWQAGVCLGGRLVAQILASRARRPGDTLTQQSAFSSSQAVLNSGVQVDLEARDFEGLTPLHTAILALNVAMRPSDLCPRVLSTQARDRLDCVHMLLQMGANHTSQEMRSCCVVQAGLQLLASSDPPSSASQSARITGVNHRTPPREIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 844429 - protein, 250 aa, Homo sapiens; identical to SEQ ID NO: 844427

SEQ ID NO: 844430 - protein, 527 aa, Homo sapiens
AAPIQGLRSPERDPGTPRPVGGPCPGLGGAITPSLKTRGYRTQDRGPGGGSAGETARLAQRRGRGPGGPQSTPRNPRVSRGERSHCPTQTVKKLLEEQRRRQQQQPDAGGVQGQFLPPPEQPLTPSVNEAVTGHPPFPAHSETVGSGPSSLGFPDWDPNTHAAYTDSPYSCPASAAENFLPPDFYPPSDPGQPCPFPQGMEDPPDTQFYVEIFSATAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLLAVLNSGVQVDLEARDFEGLTPLHTAILALNVAMRPSDLCPRVLSTQARDRLDCVHMLLQMGANHTSQEIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 844431 - protein, 150 aa, Homo sapiens
MRSCCVVQAGLQLLASSDPPSSASQSARITGVNHRTPPREIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 844432 - protein, 250 aa, Homo sapiens; identical to SEQ ID NO: 844427

SEQ ID NO: 844433 - protein, 250 aa, Homo sapiens; identical to SEQ ID NO: 844427

SEQ ID NO: 844434 - protein, 71 aa, Homo sapiens
VKKLLEEQRRRQQQQPDAGGVQVRPGSHSSPEAPCCPVGTQRLAGPSGLMRGVVLTEMSYRSETDPEESAR

SEQ ID NO: 844435 - protein, 125 aa, Homo sapiens
APPSAWRAFPTSPSNLTDFSPSFALSTAPAAVEEEPCGAARPVLLGLKPRPWTDFPVPTVLRDSQRMLMLQTHDNVCGISCHWGFTLKPQNGCRGVNRPQYLGCCDTPLLPTRSPLDDFCEIEAP

SEQ ID NO: 844436 - protein, 608 aa, Homo sapiens
AAPIQGLRSPERDPGTPRPVGGPCPGLGGAITPSLKTRGYRTQDRGPGGGSAGETARLAQRRGRGPGGPQSTPRNPRVSRGERSHCPTQTVKKLLEEQRRRQQQQPDAGGVQGQFLPPPEQPLTPSVNEAVTGHPPFPAHSETVGSGPSSLGFPDWDPNTHAAYTDSPYSCPASAAENFLPPDFYPPSDPGQPCPFPQGMEDPPDTQFYVEIFSATAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLLVMASWQAGVCLGGRLVAQILASRARRPGDTLTQQSAFSSSQAVLNSGVQVDLEARDFEGLTPLHTAILALNVAMRPSDLCPRVLSTQARDRLDCVHMLLQMGANHTSQEMRSCCVVQAGLQLLASSDPPSSASQSARITGVNHRTPPREIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 844437 - protein, 250 aa, Homo sapiens; identical to SEQ ID NO: 844427

SEQ ID NO: 844438 - protein, 539 aa, Homo sapiens
AAPIQGLRSPERDPGTPRPVGGPCPGLGGAITPSLKTRGYRTQDRGPGGGSAGETARLAQRRGRGPGGPQSTPRNPRVSRGERSHCPTQTVKKLLEEQRRRQQQQPDAGGVQGQFLPPPEQPLTPSVNEAVTGHPPFPAHSETVGSGPSSLGFPDWDPNTHAAYTDSPYSCPASAAENFLPPDFYPPSDPGQPCPFPQGMEAGPWRVSAPPSGPPQFPAVVPGPSLEVARAHMLALGPQQLLAQDEEGDTLSIRDRVVCRLLAWWGLSHGCPPPVLRLLHLFAARGLRWAAYAAAEVLQVYRRLDIREHKGKTPLLVAAAANQPLIVEDLLNLGAEPNAADHQGRSVLHVAATYGLPGVLLAVLNSGVQVDLEARDFEGLTPLHTAILALNVAMRPSDLCPRVLSTQARDRLDCVHMLLQMGANHTSQEIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 844439 - protein, 622 aa, Homo sapiens
AAPIQGLRSPERDPGTPRPVGGPCPGLGGAITPSLKTRGYRTQDRGPGGGSAGETARLAQRRGRGPGGPQSTPRNPRVSRGERSHCPTQTVKKLLEEQRRRQQQQPDAGGVQGQFLPPPEQPLTPSVNEAVTGHPPFPAHSETVGSGPSSLGFPDWDPNTHAAYTDSPYSCPASAAENFLPPDFYPPSDPGQPCPFPQGMEAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLLVWPAGRQGFVWGVDWLPRFWLPGPGGQGIPLPSSLPSLPPRLCLTLGSRLTWKPETSRVSWVWAGLVWLVWLGEVGADAGPHCLHSAGLTPLHTAILALNVAMRPSDLCPRVLSTQARDRLDCVHMLLQMGANHTSQEMRSCCVVQAGLQLLASSDPPSSASQSARITGVNHRTPPREIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 844440 - protein, 250 aa, Homo sapiens; identical to SEQ ID NO: 844427

SEQ ID NO: 844441 - protein, 250 aa, Homo sapiens; identical to SEQ ID NO: 844427

SEQ ID NO: 844442 - protein, 132 aa, Homo sapiens
MDLPYYHGRLTKQDCETLLLKEGVDGNFLLRDSESIPGVLCLCVSFKNIVYTYRIFREKHGYYRIQTAEGSPKQVFPSLKELISKFEKPNQGMVVHLLKPIKRTSPSLRWRGLKLELETFVNSNSDYVDVLP

SEQ ID NO: 844443 - protein, 108 aa, Homo sapiens
MGLFAAFPTPLSLPGSQPVFPYQGFCHPWPMSVHLGSPPSIITSCPRELPVPLFQLFPSLAVEIVSTFDLLLSSDLLLSSYSLCAARFPRSVAFSSLGFLLYSDFQLF

SEQ ID NO: 844444 - protein, 196 aa, Homo sapiens
APPWLPWSAGRAARSSRKCPRSRFPVQVGKMAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATEAKPAPEIFENEVMALLRDFAKNKNKEQRLRAPDLEYLFEKPR

SEQ ID NO: 844445 - protein, 196 aa, Homo sapiens; identical to SEQ ID NO: 844444

SEQ ID NO: 844446 - protein, 196 aa, Homo sapiens; identical to SEQ ID NO: 844444

SEQ ID NO: 844447 - protein, 144 aa, Homo sapiens
APPWLPWSAGRAARSSRKCPRSRFPVQVGKMAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPRS

SEQ ID NO: 844448 - protein, 196 aa, Homo sapiens; identical to SEQ ID NO: 844444

SEQ ID NO: 844449 - protein, 196 aa, Homo sapiens; identical to SEQ ID NO: 844444

SEQ ID NO: 844450 - protein, 258 aa, Homo sapiens
APPWLPWSAGRAARSSRKCPRSRFPVQVGKMAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATGPLVALPNSIMMGKLPLGVVSPYVKMSSGGYTDPLKFYATSYCNSLRSGRISKPRVGSHVGTGYKSNYQPRGTHAKASLEALDNPDRQENKPRTIYRLWPAETIA

SEQ ID NO: 844451 - protein, 194 aa, Homo sapiens
MLSLCAQDLTQMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATEANPAKKKKKKKKKFWGRPARKFKPLLAPAPGGTATVQEPGRLGVSQKPGAGSHPGVGPVPAAIPPPAGGTQ

SEQ ID NO: 844452 - protein, 196 aa, Homo sapiens; identical to SEQ ID NO: 844444

SEQ ID NO: 844453 - protein, 165 aa, Homo sapiens
MLSLCAQDLTQMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATEAKPAPEIFENEVMALLRDFAKNKNKEQRLRAPDLEYLFEKPR

SEQ ID NO: 844454 - protein, 196 aa, Homo sapiens; identical to SEQ ID NO: 844444

SEQ ID NO: 844455 - protein, 196 aa, Homo sapiens; identical to SEQ ID NO: 844444

SEQ ID NO: 844456 - protein, 117 aa, Homo sapiens
APPWLPWSAGRAARSSRKCPRSRFPVQVGKMAVSTVFSTSSLMLALSRHSLLSPLLSVTSFRRFYRGDSPTDSQKDMIEIPLPPWQERTDESIETKRARLLYESRKRGMLENCILRS

SEQ ID NO: 844457 - protein, 175 aa, Homo sapiens
APPWLPWSAGRAARSSRKCPRSRFPVQVGKMAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATGDWVPGYVIEYSSGCFYEDVFG

SEQ ID NO: 844458 - protein, 192 aa, Homo sapiens
MRHNYYKLHLPTTNRPKIAHCILFNQPHSPRSNSHSHPNPLKLHRRSHSHNPHGPRDPRGSEQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQLSDSPFSSPDRPPFQQDIVI

SEQ ID NO: 844459 - protein, 1111 aa, Homo sapiens
MTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844460 - protein, 945 aa, Homo sapiens
VSWVEIGEGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844461 - protein, 1137 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDERWFNGMKGCLSCSYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844462 - protein, 830 aa, Homo sapiens
RARYPSKTTVNFTCQIVQTQRPDIQTREVTFMSRLMKCELELKCQKLHHRELGVRLDSSEVNTHQEPKKVSKLLDIALIELFKPALHCVGIVILGDFLQEEKVCWNIRSKYSSHSIGTQFLDMSSLMLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844463 - protein, 732 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844464 - protein, 634 aa, Homo sapiens
PPVLIRPRVMELLSHAAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844465 - protein, 1125 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844466 - protein, 591 aa, Homo sapiens
MSTVHEILCKLSLEGDHSTPPSAYGSVKAYTNFDAERDALNIETAIKTKGVDEVTLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844467 - protein, 1145 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRVRRERGRAKRRAEWARKPGTCAARRGHIEASGRGLCPPCSLAAAHEMPADLVL

SEQ ID NO: 844468 - protein, 258 aa, Homo sapiens
MYTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844469 - protein, 482 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGELSDSPFSSPTSTFLNKISSTWRLSTPSRSCTTRRSSGLPCCSSL

SEQ ID NO: 844470 - protein, 230 aa, Homo sapiens [sequence omitted]

SEQ ID NO: 844471 - protein, 620 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDV

SEQ ID NO: 844472 - protein, 630 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAHHKDGPSS

SEQ ID NO: 844473 - protein, 414 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQSTHEGY

SEQ ID NO: 844474 - protein, 216 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTEMGQALQSQGTDILTLHQGWELLIQQFG

SEQ ID NO: 844475 - protein, 39 aa, Homo sapiens
MGKWNWSPLPSWGALPEGWEWAPGLLSHRCSPHGGERRV

SEQ ID NO: 844476 - protein, 801 aa, Homo sapiens
LNLSSKEVAGFLIVTFCLVSFSYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRVRRERGRAKRRAEWARKPGTCAARRGHIEASGRGLCPPCSLAAAHEMPADLVL

SEQ ID NO: 844477 - protein, 1125 aa, Homo sapiens; identical to SEQ ID NO: 844465

SEQ ID NO: 844478 - protein, 891 aa, Homo sapiens
YGAGVNCYEFVVRFTWTCLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844479 - protein, 774 aa, Homo sapiens [sequence omitted]

SEQ ID NO: 844480 - protein, 743 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKRMSSSGPCAPSTTPASSLHSPGTIAT

SEQ ID NO: 844481 - protein, 1118 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRNVHRLVNDLRYYRLCNDSLPPGTVKL

SEQ ID NO: 844482 - protein, 602 aa, Homo sapiens
KGGRGRAAEDVSTGRAVTPAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844483 - protein, 397 aa, Homo sapiens
CCAPAVLRSRRCALPPVVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 844484 - protein, 1145 aa, Homo sapiens; identical to SEQ ID NO: 844467

SEQ ID NO: 844485 - protein, 942 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSLMEASRMVPSY

SEQ ID NO: 844486 - protein, 137 aa, Homo sapiens
RPRGTSGRLQGGRAQGCSRGRRQWPCGLRLRGQRGPPGLSPEPAAWAARSRPVSLRPFSLGAGAAATSARGGRGAPAWARSLPRGGRARAGVPSSCPPRRHPSLISCFFSFLGEGRVGLDELSRGPPMRRPGRPCPF

SEQ ID NO: 844487 - protein, 743 aa, Homo sapiens; identical to SEQ ID NO: 844480

SEQ ID NO: 844488 - protein, 693 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKSRKLCYRWHYGSGTTWRFGQSGQVP

SEQ ID NO: 844489 - protein, 545 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGFDDKCQHQGQETNDYRYRAD

SEQ ID NO: 844490 - protein, 371 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDERIWGSW

SEQ ID NO: 844491 - protein, 568 aa, Homo sapiens
AVAVAAASRRQSCYLCDLPRMPWAMIWDFTEPVCRGCVNYEGADRVEFVIETARQLKRAHGCFPEGRSPPGAAAPAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 844492 - protein, 532 aa, Homo sapiens
GWPLTLALESGDARSCERALKRAHGCFPEGRSPPGAAAPAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 844493 - protein, 584 aa, Homo sapiens
AVAVAAASRRQSCYLCDLPRMPWAMIWDFTEPVCRGCVNYEGADRVEFVIETARQLKRAHGCFPEGRSPPGAAAPAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAGRLLGFEANGANGSKAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 844494 - protein, 568 aa, Homo sapiens; identical to SEQ ID NO: 844491

SEQ ID NO: 844495 - protein, 197 aa, Homo sapiens [sequence omitted]

SEQ ID NO: 844496 - protein, 259 aa, Homo sapiens
EKKKEKRKEKERSTKKTGLVAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 844497 - protein, 568 aa, Homo sapiens; identical to SEQ ID NO: 844491

SEQ ID NO: 844498 - protein, 568 aa, Homo sapiens; identical to SEQ ID NO: 844491

SEQ ID NO: 844499 - protein, 568 aa, Homo sapiens; identical to SEQ ID NO: 844491

SEQ ID NO: 844500 - protein, 568 aa, Homo sapiens; identical to SEQ ID NO: 844491

SEQ ID NO: 844501 - protein, 568 aa, Homo sapiens; identical to SEQ ID NO: 844491

SEQ ID NO: 844502 - protein, 533 aa, Homo sapiens
AVAVAAASRRQSCYLCDLPRMPWAMIWDFTEPVCRGCVNYEGADRVEFVIETARQLKRAHGCFPEGRSPPGAAAPAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGCLPNQATLYT

SEQ ID NO: 844503 - protein, 568 aa, Homo sapiens; identical to SEQ ID NO: 844491

SEQ ID NO: 844504 - protein, 568 aa, Homo sapiens; identical to SEQ ID NO: 844491

SEQ ID NO: 844505 - protein, 473 aa, Homo sapiens
AVAVAAASRRQSCYLCDLPRMPWAMIWDFTEPVCRGCVNYEGADRVEFVIETARQLKRAHGCFPEGRSPPGAAAPAAAKPPPLSAKDILLQQQQQLGHGGPEAAPRAPQALERYPLAAAAERPPRLGSDFGSSRPAASLAQAADAAAAARERHPGAQRLLQARGAARLSAEGAGKSRGSGEQDWVNRPKTVRDTLLALHQHGHSGPFESKFKKEPALTAGRLLGFEANGANGSKAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 844506 - protein, 383 aa, Homo sapiens
AVAVAAASRRQSCYLCDLPRMPWAMIWDFTEPVCRGCVNYEGADRVEFVIETARQLKRAHGCFPEGRSPPGAAAPAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAGRLLGFEANGANGSKAVAVHIHRGAQDPHDSYILFCVSATTHCLTSFQPDHTA

SEQ ID NO: 844507 - protein, 197 aa, Homo sapiens [sequence omitted]

SEQ ID NO: 844508 - protein, 163 aa, Homo sapiens
MAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 844509 - protein, 568 aa, Homo sapiens; identical to SEQ ID NO: 844491

SEQ ID NO: 844510 - protein, 601 aa, Homo sapiens
AVAVAAASRRQSCYLCDLPRMPWAMIWDFTEPVCRGCVNYEGADRVEFVIETARQLKRAHGCFPEGRSPPGAAAPAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKNKKKTSRLVLSLLSQPYGPEPSLLTGADLSRSGVQAAG

SEQ ID NO: 844511 - protein, 413 aa, Homo sapiens
AVAVAAASRRQSCYLCDLPRMPWAMIWDFTEPVCRGCVNYEGADRVEFVIETARQLKRAHGCFPEGRSPPGAAAPAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAGRLLGFEANGANGSKAGRGGCEVRGSRGEKGTESRGRVVLWIHHFTPAQKQQTPHFLICLRRNQCLVATCSCLKQHNRDESDW

SEQ ID NO: 844512 - protein, 134 aa, Homo sapiens
MTVISVEKGTVCPRHFAFMLKRVEDSKPAEAGPLHPPVPRWVGGGGLFPGFPSTLSVVTTDYCVDNGKPGAEARSLTTRAWPPLQEDCHQKIDDLFSGKLYLIGIAAIVVAVIMIFEMILSMVLCCGIRNSSVY

SEQ ID NO: 844513 - protein, 159 aa, Homo sapiens
ATFRLIAGDSDFYVVSRIRIVKMISVQGRLMVDIARAALPIRCMSRWPAIIPGLIEAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844514 - protein, 273 aa, Homo sapiens
HCAGKARNGGDGGDPTAHPARPPAPSGPRAPAAARAAMGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844515 - protein, 225 aa, Homo sapiens
GGSRWQRGFPQLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844516 - protein, 305 aa, Homo sapiens
ITQRRTRAVACPSSMHPCCGVPVVCVACLSVHPCCGVPVVCVACLSVHPCVACPSSVHPCCGVPFVCSFYCRAGLHPHVQASDGPQVHPFTLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844517 - protein, 231 aa, Homo sapiens
QTQDVPLPAPEAPSPDELAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844518 - protein, 242 aa, Homo sapiens
MEEVTEAQKTHQARLGCEVPCCSSLAVSNPTSSQLGGPWWVRHPGPSGVLGCGECVGTHLVSLSPQGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844519 - protein, 138 aa, Homo sapiens
GRVGRPTRRAADLGLVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844520 - protein, 316 aa, Homo sapiens
IVLERRATAATAATPPRILPGLRRPAAHAPPRPRAPRPFLRAPAPRPARPPCRPPARPRAGPPAAQDRPAPRRPPAARAAMGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844521 - protein, 316 aa, Homo sapiens; identical to SEQ ID NO: 844520

SEQ ID NO: 844522 - protein, 75 aa, Homo sapiens
VDMIESSSVPEHSCPSRQQHISNLFKEDCHQKIDDLFSGKLYLIGIAAIVVAVIMIFEMILSMVLCCGIRNSSVY

SEQ ID NO: 844523 - protein, 316 aa, Homo sapiens
IVLERRATAATAATPPRILPGLRRPAAHAPPRPRAPRPFLRAPAPRPARPPCRPPARPRAGPPAAQDRPAPRRPPAARAAMGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMVSGRGRRGCSLGCPFRGALC

SEQ ID NO: 844524 - protein, 229 aa, Homo sapiens
MAPFVHARAGKTKAQLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMVSGRGRRGCSLGCPFRGALC

SEQ ID NO: 844525 - protein, 316 aa, Homo sapiens; identical to SEQ ID NO: 844520

SEQ ID NO: 844526 - protein, 316 aa, Homo sapiens; identical to SEQ ID NO: 844520

SEQ ID NO: 844527 - protein, 336 aa, Homo sapiens
IVLERRATAATAATPPRILPGLRRPAAHAPPRPRAPRPFLRAPAPRPARPPCRPPARPRAGPPAAQDRPAPRRPPAARAAMGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLNDNLCIIGKVRISGRQGFYPNQQHKRQYNC

SEQ ID NO: 844528 - protein, 346 aa, Homo sapiens
IVLERRATAATAATPPRILPGLRRPAAHAPPRPRAPRPFLRAPAPRPARPPCRPPARPRAGPPAAQDRPAPRRPPAARAAMGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIETMQARGFGSDQSENVDRGAGSIREAGGAFGKREQAEEERYFRAQSREQLAALKKHHEEEIVHHKKEIERLQ

SEQ ID NO: 844529 - protein, 211 aa, Homo sapiens
IVLERRATAATAATPPRILPGLRRPAAHAPPRPRAPRPFLRAPAPRPARPPCRPPARPRAGPPAAQDRPAPRRPPAARAAMGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQTRQGCEAAPAAPQ

SEQ ID NO: 844530 - protein, 316 aa, Homo sapiens; identical to SEQ ID NO: 844520

SEQ ID NO: 844531 - protein, 80 aa, Homo sapiens
MLSPNTFYVGIYILIAVGAVMMFVGFLGCYGAIQESQCLLGTFFTCLVILFACEVAAGIWGFVNKDQIAKDVKQHQQHHN

SEQ ID NO: 844532 - protein, 229 aa, Homo sapiens
MAPFVHARAGKTKAQLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844533 - protein, 274 aa, Homo sapiens
MWCGWSFSWQPVHWVRSACGCSLTWVSWSLASSSSRSLLKVGELGMAPFVHARAGKTKAQLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844534 - protein, 270 aa, Homo sapiens
ATFPVPSSHLCQGVIQVQNIPIVAEEFYQLALGWTTLAKTSWLEDGSPDLVPRGSQLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844535 - protein, 217 aa, Homo sapiens
WHWACHKDQIAKDVKQFYDQALQQAVVDDDADNAKAVVKTFRIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844536 - protein, 111 aa, Homo sapiens
KKLSILVKAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 844537 - protein, 316 aa, Homo sapiens; identical to SEQ ID NO: 844520

SEQ ID NO: 844538 - protein, 316 aa, Homo sapiens; identical to SEQ ID NO: 844520

SEQ ID NO: 844539 - protein, 316 aa, Homo sapiens; identical to SEQ ID NO: 844520

SEQ ID NO: 844540 - protein, 316 aa, Homo sapiens; identical to SEQ ID NO: 844520

SEQ ID NO: 844541 - protein, 64 aa, Homo sapiens
MACPGREAALERALGTRVEMEVGLWPAGPSGLSQGRGWQLGLGRDCVETLLILSVGDTSRRLPE

SEQ ID NO: 844542 - protein, 103 aa, Homo sapiens
MAPFVHARAGKTKAQVRPLPSAWHSFLPHFSTQGGSRLLLVASGTVEVDRLASPPFPAVPPTPSWPSCSALLKVTWALGSFLVLAQALSGPAGQDQPSLQPSA

SEQ ID NO: 844543 - protein, 172 aa, Homo sapiens
MNRYSVDTSASTFNHRGSLHPSSSLYCKRQNSGDSHLGGGPAATAGGPRTSPMSSGGPSAPGLRPPASSPKRNTTSLEGNRCASSPSQDAQDARRPRSRNPSAWTVEDVVWFVKDADPQALGPHVELFRKHEIDGNALLLLKSDMVMKYLGLKLGPALKLCYHIDKLKQAKF

SEQ ID NO: 844544 - protein, 172 aa, Homo sapiens; identical to SEQ ID NO: 844543

SEQ ID NO: 844545 - protein, 99 aa, Homo sapiens
NDEPLLSGSGDVSKECAEKILETWGELLSKWHLNLNVRPKQLSSLVRNGVPEALRGEVWQLLAGCHNNDHLVEKYRILITKVTVLEYFLLLGPLHDGLL

SEQ ID NO: 844546 - protein, 582 aa, Homo sapiens
NDEPLLSGSGDVSKECAEKILETWGELLSKWHLNLNVRPKQLSSLVRNGVPEALRGEVWQLLAGCHNNDHLVEKYRILITKESPQDSAITRDINRTFPAHDYFKDTGGDGQDSLYKICKAYSVYDEEIGYCQGQSFLAAVLLLHFKMLGKNTTQVMSAKSFGTCYDLYCAEDAEMPEEQAFSVLVKIMFDYGLRELFKQNFEDLHCKFYQLERLMQEYIPDLYNHFLDISLEAHMYASQWFLTLFTAKFPLYMVFHIIDLLLCEGISVIFNVALGLLKTSKDDLLLTDFEGALKFFRVQLPKRYRSEENAKKLMELACNMKISQKKLKKYEKEYHTMREQQAQQEDPIERFERENRRLQEANMRLEQENDDLAHELVTSKIALRKDLDNAEEKADALNKELLMTKQKLIDAEEEKRRLEEESAQLKEMCRRELDKAESEIKKNSSIIGDYKQICSQLSERLEKQQTANKVEIEKIRQKVDDCERCREFFNKEGRVKGISSTKEVLDEDTDEEKETLKNQLREMELELAQTKLQLVEAECKIQDLEHHLGLALNEVQAAKKTWFNRTLSSIKTATGVQGKETC

SEQ ID NO: 844547 - protein, 246 aa, Homo sapiens [sequence omitted]

SEQ ID NO: 844548 - protein, 552 aa, Homo sapiens
NDEPLLSGSGDVSKECAEKILETWGELLSKWHLNLNVRPKQLSSLVRNGVPEALRGEVWQLLAGCHNNDHLVEKYRILITKESPQDSAITRDINRTFPAHDYFKDTGGDGQDSLYKICKAYSVYDEEIGYCQGQSFLAAVLLLHMPEEQAFSVLVKIMFDYGLRELFKQNFEDLHCKFYQLERLMQEYIPDLYNHFLDISLEAHMYASQWFLTLFTAKFPLYMVFHIIDLLLCEGISVIFNVALGLLKTSKDDLLLTDFEGALKFFRVQLPKRYRSEENAKKLMELACNMKISQKKLKKYEKEYHTMREQQAQQEDPIERFERENRRLQEANMRLEQENDDLAHELVTSKIALRKDLDNAEEKADALNKELLMTKQKLIDAEEEKRRLEEESAQLKEMCRRELDKAESEIKKNSSIIGDYKQICSQLSERLEKQQTANKVEIEKIRQKVDDCERCREFFNKEGRVKGISSTKEVLDEDTDEEKETLKNQLREMELELAQTKLQLVEAECKIQDLEHHLGLALNEVQAAKKTWFNRTLSSIKTATGVQGKETC

SEQ ID NO: 844549 - protein, 399 aa, Homo sapiens
NDEPLLSGSGDVSKECAEKILETWGELLSKWHLNLNVRPKQLSSLVRNGVPEALRGEVWQLLAGCHNNDHLVEKYRILITKESPQDSAITRDINRTFPAHDYFKDTGGDGQDSLYKICKAYSVYDEEIGYCQGQSFLAAVLLLHMPEEQAFSVLVKIMFDYGLRELFKQNFEDLHCKFYQLERLMQEYIPDLYNHFLDISLEAHMYASQWFLTLFTAKFPLYMVFHIIDLLLCEGISVIFNVALGLLKTSKDDLLLTDFEGALKFFRVQLPKRYRSEENAKKLMELACNMKISQKKLKKYEKEYHTMREQQAQQEDPIERFERENRRLQEANMRLEQENDDLAHELVTSKIALRKDLDNAEEKADALNKELLMTKQKLIDAEEEKRRTGFVYKDTRVVL

SEQ ID NO: 844550 - protein, 70 aa, Homo sapiens
QEANMRLEQENDDLAHELVTSKIALRKDLDNVSPTGLKGKISLRHLTFPLKRNPGILVIVILATCKVSRL

SEQ ID NO: 844551 - protein, 552 aa, Homo sapiens; identical to SEQ ID NO: 844548

SEQ ID NO: 844552 - protein, 246 aa, Homo sapiens [sequence omitted]

SEQ ID NO: 844553 - protein, 552 aa, Homo sapiens; identical to SEQ ID NO: 844548

SEQ ID NO: 844554 - protein, 147 aa, Homo sapiens [sequence omitted]

SEQ ID NO: 844555 - protein, 302 aa, Homo sapiens
NDEPLLSGSGDVSKECAEKILETWGELLSKWHLNLNVRPKQLSSLVRNGVPEALRGEVWQLLAGCHNNDHLVEKYRILITKESPQDSAITRDINRTFPAHDYFKDTGGDGQDSLYKICKAYSVYDEEIGYCQGQSFLAAVLLLHMPEEQAFSVLVKIMFDYGLRELFKQNFEDLHCKFYQLERLMQEYIPDLYNHFLDISLEAHMYASQWFLTLFTAKFPLYMVFHIIDLLLCEGISVIFNVALGLLKTSKDDLLLTDFEGALKFFRVQLPKRYRSEENAKKLMELACNMKPTHHEDNQDED

SEQ ID NO: 844556 - protein, 161 aa, Homo sapiens
SKAVNRLFGVEASGRRIWIRRAGGRCLWRDDLLEPATKPSIAGKFKVLEPPMLGHDLRLALCLANLTSRAQRVRVNLSGATILYTRKPVAEILHESHAVRLGPQEEKRIPITISYSKYKEDLTEDKKILLAAMCLVTKGEKLLVEKDITLEDFITIKVTSA

SEQ ID NO: 844557 - protein, 377 aa, Homo sapiens
NGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVK

SEQ ID NO: 844558 - protein, 423 aa, Homo sapiens
GWLANGSTAHPVVFPVADCGNGRVGIVSLGARKNLSERWDAYCFLCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYVSDLCSPDAVWVCAVGWVSAHPATAPDRNLGAHGGSEVAAASFLPHNPGAQVIDLPVAKHLPTCLLQRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLV

SEQ ID NO: 844559 - protein, 85 aa, Homo sapiens
ENVNSLLPVFEEFLKNAPNDASYDAVRQSVVVLMGSLAKHLDKSDPKVKPIVAKLIAALSTPSQQVPAIWPGTHMSVRELGPGCG

SEQ ID NO: 844560 - protein, 356 aa, Homo sapiens
GWLANGSTAHPVVFPVADCGNGRVGIVSLGARKNLSERWDAYCFLCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLV

SEQ ID NO: 844561 - protein, 240 aa, Homo sapiens
MILISTQYHTHHPPKNRARPPQNTTPNPTTTTHSPPPPPPKNHTTTHTTARGHPGTQDNDKTHPCTNPGDHPTDTHAPTPTEHNKDQTTQKLQRKPTERKHKRASSKTPPQSTRRPPRHKTAQTSNTEYKSDSQRTKHSPPPHTTGDQTTAPPAQPRDAQNALQQLSTSRRRGDKKAHNSRQCVRGGEREKSRSAKQRADGGASEQHREDSPGEHNHTDGRQEDLESRRHTTHVTRLRPT

SEQ ID NO: 844562 - protein, 240 aa, Homo sapiens; identical to SEQ ID NO: 844561

SEQ ID NO: 844563 - protein, 39 aa, Homo sapiens
ACNWLNPKVLREATYNRKQNHSTNQRGTGITACCLTPST

SEQ ID NO: 844564 - protein, 40 aa, Homo sapiens
MDQVTVLVPSVLWAKKRWAQNDGNAERKGPTLPGGEDKNS

SEQ ID NO: 844565 - protein, 125 aa, Homo sapiens [sequence omitted]

SEQ ID NO: 844566 - protein, 108 aa, Homo sapiens
MELRRKDQSLRQLNRHLTQLEQDKRRLEENIHDAESALRMAAKDKECVANHMRAVENTLHKVRDQISLSWSAASRNDFTLQLPKLHLETFAMEGLKGGPEVVACQVRV

SEQ ID NO: 844567 - protein, 116 aa, Homo sapiens
SGEYCARMTGRLFIHRDLVQGLTSVIQTGVQQCDLSSLQPPPPRFKRLSCLSLHNNWDHRCVPQHLANFCIFFMETEFYCVGQGGLELLTSNDPPASASQSTGITAHISKIGKILN

SEQ ID NO: 844568 - protein, 140 aa, Homo sapiens [sequence omitted]

SEQ ID NO: 844569 - protein, 176 aa, Homo sapiens
MGVRDPLEEAVCPLAELECCAGRSAALFRADRQERLSLLKLCPQLPPFPQAMIKSFMDVYQLASTRIMTLEKEMTSHRSHIAALKSELHTACLRENASLQSIGSRDHSNLSIPSRAPLPADTTGIGDFLPLKAELDTTYTFLKETFINTVPHALTSSHSSPVTMSANANRPTQIGL

SEQ ID NO: 844570 - protein, 108 aa, Homo sapiens; identical to SEQ ID NO: 844566

SEQ ID NO: 844571 - protein, 567 aa, Homo sapiens
MRSAVLKSLQPGSLPDCKAALGGSGNISTSPFWSRRHSEGQDTGTRAVLLYGAVCASLRQRDALKFWREKRCIWIPAVVGKGQSAEVLGGVMAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKVWLPAT

SEQ ID NO: 844572 - protein, 567 aa, Homo sapiens; identical to SEQ ID NO: 844571

SEQ ID NO: 844573 - protein, 567 aa, Homo sapiens; identical to SEQ ID NO: 844571

SEQ ID NO: 844574 - protein, 567 aa, Homo sapiens; identical to SEQ ID NO: 844571

SEQ ID NO: 844575 - protein, 476 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKVWLPAT

SEQ ID NO: 844576 - protein, 382 aa, Homo sapiens
MEKPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKVWLPAT

SEQ ID NO: 844577 - protein, 567 aa, Homo sapiens; identical to SEQ ID NO: 844571

SEQ ID NO: 844578 - protein, 567 aa, Homo sapiens
MRSAVLKSLQPGSLPDCKAALGGSGNISTSPFWSRRHSEGQDTGTRAVLLYGAGARVLRQRDALKFWREKRCIWIPAVVGKGQSAEVLGGVMAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKVWLPAT

SEQ ID NO: 844579 - protein, 567 aa, Homo sapiens; identical to SEQ ID NO: 844571

SEQ ID NO: 844580 - protein, 567 aa, Homo sapiens; identical to SEQ ID NO: 844571

SEQ ID NO: 844581 - protein, 492 aa, Homo sapiens
MRSAVLKSLQPGSLPDCKAALGGSGNISTSPFWSRRHSEGQDTGTRAVLLYGAGARVCGSVTPSSFGGKSAAFGFLQWWAKDSPPRCSVESWQCPLWKTGTWCKPWEKVPMEKPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKVWLPAT

SEQ ID NO: 844582 - protein, 332 aa, Homo sapiens
MRSAVLKSLQPGSLPDCKAALGGSGNISTSPFWSRRHSEGQDTGTRAVLLYGAVCASLRQRDALKFWREKRCIWIPAVVGKGQSAEVLGGVMAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLGN

SEQ ID NO: 844583 - protein, 195 aa, Homo sapiens
MFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 844584 - protein, 386 aa, Homo sapiens
MGVWDRKPGACLWGSPSWWLGLQGDSEEPRPGPSPAPFSGQAKWQRLAMEGSTCLDVFEHISLMTLDSLQKCIFSFDSNCQEKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 844585 - protein, 294 aa, Homo sapiens
MGVWDRKPGACLWGSPSWWLGLQGDSEEPRPGPSPAPFSGQAKWQRLAMEGSTCLDVFEHISLMTLDSLQKCIFSFDSNCQEKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGTASGRSSRWQR

SEQ ID NO: 844586 - protein, 370 aa, Homo sapiens
MPMMAKLCPGDLGQEAAHREWEAESEVRLQDTPFCMECGPGILAGRCSQAFMWVRSCFLSLDWPCRKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 844587 - protein, 189 aa, Homo sapiens
MGLYGRLTVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 844588 - protein, 522 aa, Homo sapiens
RRMSLLSLSWLGLRPVAASPWLLLLVVGASWLLARILAWTYAFYHNGRRLRCFPQPRKQNWFLGHLGLVTPTEEGLRVLTQLVATYPQGFVRWLGPITPIINLCHPDIVRSVINTSDAITDKDIVFYKTLKPWLGDGLLLSVGDKWRHHRRLLTPAFHFNILKPYIKIFSKSANIMHAKWQRLAMEGSTCLDVFEHISLMTLDSLQKCIFSFDSNCQEKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 844589 - protein, 328 aa, Homo sapiens
MPMMAKLCPGDLGQEAAHREWEAESEVRLQDTPFCMECGPGILAGRCSQAFMWVRSCFLSLDWPCRKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPELLTLSASDPENARKRSLWSYSYFGGPTDTALGQIPEGDIT

SEQ ID NO: 844590 - protein, 284 aa, Homo sapiens
MGVWDRKPGACLWGSPSWWLGLQGDSEEPRPGPSPAPFSGQAKWQRLAMEGSTCLDVFEHISLMTLDSLQKCIFSFDSNCQEKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGL

SEQ ID NO: 844591 - protein, 305 aa, Homo sapiens
MKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 844592 - protein, 558 aa, Homo sapiens
FPQTRKRIAWSEGHAAARLTSKESCCDEKAQKRRKRKAKESGMALPQGHLTFRDVAIEFSQAEWKCLDPAQRALYKDVMLENYRNLVSLGISLPDLNINSMLEQRREPWSGESEVKIAKNSDGRECIKGVNTGSSYALGSNAEDKPIKKQLGVSFHLHLSELELFPDERVINGCNQVENFINHSSSVSCLQEMSSSVKTPIFNRNDFDDSSFLPQEQKVHLREKPYECNEHSKVFRVSSSLTKHQVIHTVEKPYKCNSCGKVFSRNSHLAEHCRIHTGEKPYKCNVCGKVFSYNSNFARHQRIHTREKPYECNECGKVFSNNSYLARHQRIHAEEKPYKCNECGKGFSHKSSLANHWRIYTGEKPYKCDECGKAFYRIALLVRHQKIHTGEKPYKCNECGKVFIQNSHLAQHWRIHTGEKPYKCNECGKVFNQLSNLARHRRIHTGEKPYKCNECGKAFSEYSGLSAHLVIHTGEKPYKCSECGKAFRHKLSLTNHQRIHTGERPYKCNECGKVFNRIAHLARHRKIHTGEKPYKCNECGKAFSRISYLAQHWTIHMG

SEQ ID NO: 844593 - protein, 358 aa, Homo sapiens
HVPYAMFVIMLLAATCGNGHPKEKPYECNEHSKVFRVSSSLTKHQVIHTVEKPYKCNSCGKVFSRNSHLAEHCRIHTGEKPYKCNVCGKVFSYNSNFARHQRIHTREKPYECNECGKVFSNNSYLARHQRIHAEEKPYKCNECGKGFSHKSSLANHWRIYTGEKPYKCDECGKAFYRIALLVRHQKIHTGEKPYKCNECGKVFIQNSHLAQHWRIHTGEKPYKCNECGKVFNQLSNLARHRRIHTGEKPYKCNECGKAFSEYSGLSAHLVIHTGEKPYKCSECGKAFRHKLSLTNHQRIHTGERPYKCNECGKVFNRIAHLARHRKIHTGEKPYKCNECGKAFSRISYLAQHWTIHMG

SEQ ID NO: 844594 - protein, 401 aa, Homo sapiens
MDLTQQAKDIQNITVQETNKNNSESIECSKITMDLKFNNSRKYISITVPSKTQTMSPHIKSVDDVVVLGMNLSKFNKLTQFFICVAGVFVFYLIYGYLQELIFSVEGFKSCGWYLTLVQFAFYSIFGLIELQLIQDKRRRIPGKTYMIIAFLTVGTMGLSNTSLGYLNYPTQVIFKCCKLIPVMLGGVFIQGKRYNVADVSAAICMSLGLIWFTLADSTTAPNFNLTGVVLISLALCADAVIGNVQEKAMKLHNASNSEMVLYSYSIGFVYILLGLTCTSGLGPAVTFCAKNPVRTYGYAFLFSLTGYFGISFVLALIKIFGALIAVTVTTGRKAMTIVLSFIFFAKPFTFQYVWSGLLVVLGIFLNVYSKNMDKIRLPSLYDLINKSVEARKSRTLAQTV

SEQ ID NO: 844595 - protein, 401 aa, Homo sapiens; identical to SEQ ID NO: 844594

SEQ ID NO: 844596 - protein, 403 aa, Homo sapiens
MDEDLTQQAKDIQNITVQETNKNNSESIECSKITMDLKFNNSRKYISITVPSKTQTMSPHIKSVDDVVVLGMNLSKFNKLTQFFICVAGVFVFYLIYGYLQELIFSVEGFKSCGWYLTLVQFAFYSIFGLIELQLIQDKRRRIPGKTYMIIAFLTVGTMGLSNTSLGYLNYPTQVIFKCCKLIPVMLGGVFIQGKRYNVADVSAAICMSLGLIWFTLADSTTAPNFNLTGVVLISLALCADAVIGNVQEKAMKLHNASNSEMVLYSYSIGFVYILLGLTCTSGLGPAVTFCAKNPVRTYGYAFLFSLTGYFGISFVLALIKIFGALIAVTVTTGRKAMTIVLSFIFFAKPFTFQYVWSGLLVVLGIFLNVYSKNMDKIRLPSLYDLINKSVEARKSRTLAQTV

SEQ ID NO: 844597 - protein, 369 aa, Homo sapiens
MDLKFNNSRKYISITVPSKTQTMSPHIKSVDDVVVLGMNLSKFNKLTQFFICVAGVFVFYLIYGYLQELIFSVEGFKSCGWYLTLVQFAFYSIFGLIELQLIQDKRRRIPGKTYMIIAFLTVGTMGLSNTSLGYLNYPTQVIFKCCKLIPVMLGGVFIQGKRYNVADVSAAICMSLGLIWFTLADSTTAPNFNLTGVVLISLALCADAVIGNVQEKAMKLHNASNSEMVLYSYSIGFVYILLGLTCTSGLGPAVTFCAKNPVRTYGYAFLFSLTGYFGISFVLALIKIFGALIAVTVTTGRKAMTIVLSFIFFAKPFTFQYVWSGLLVVLGIFLNVYSKNMDKIRLPSLYDLINKSVEARKSRTLAQTV

SEQ ID NO: 844598 - protein, 401 aa, Homo sapiens; identical to SEQ ID NO: 844594

SEQ ID NO: 844599 - protein, 394 aa, Homo sapiens
MDLTQQAKDIQNITVQETNKNNSESIECSKITMDLKFNNSRKYISITVPSKTQTMSPHIKSVDDVVVLGMNLSKFNKLTQFFICVAGVFVFYLIYGYLQELIFSVEGFKSCGWYLTLVQFAFYSIFGLIELQLIQDKRRRIPGKTYMIIAFLTVGTMGLSNTSLGYLNYPTQVIFKCCKLIPVMLGGVFIQGKRYNVADVSAAICMSLGLIWFTLADSTTAPNFNLTGVVLISLALCADAVIGNVQEKAMKLHNASNSEMVLYSYSIGFVYILLGLTCTSGLGPAVTFCAKNPVRTYGYAFLFSLTGYFGISFVLALIKIFGALIAVTVTTGRKAMTIVLSFIFFAKPFTFQYNRACIMEGSSMRNSDWFSFAHLLKYSHCFFPSGNHLKFFLA

SEQ ID NO: 844600 - protein, 161 aa, Homo sapiens
AGTHRRKWPAGAGVESAFRGGDRRGGKCRSGRGGGGRGGDGDGPGEGEMLRLAQTPRRLPSPFRVTYRPWGTRAFGAFPVFGTQISSPPENLDTAHLPHPEGAFEEWMRSGWKKRVIPFFERAETGRAVSREEHLFLLARFSPSGWRELPQVPIRGLAGVR

SEQ ID NO: 844601 - protein, 369 aa, Homo sapiens; identical to SEQ ID NO: 844597

SEQ ID NO: 844602 - protein, 369 aa, Homo sapiens; identical to SEQ ID NO: 844597

SEQ ID NO: 844603 - protein, 246 aa, Homo sapiens
MDLTQQAKDIQNITVQETNKNNSESIECSKITMDLKFNNSRKYISITVPSKTQTMSPHIKSVDDVVVLGMNLSKFNKLTQFFICVAGVFVFYLIYGYLQELIFSVEGFKSCGWYLTLVQFAFYSIFGLIELQLIQDKRRRIPGKTYMIIAFLTVGTMGLSNTSLGYLNYPTQVIFKCCKLIPVMLGGVFIQGKRYNVADVSAAICMSLGLIWFTLADSTTAPNFNLTGIVFVFNWFCIHFTGIDMH

SEQ ID NO: 844604 - protein, 171 aa, Homo sapiens
AGTHRRKWPAGAGVESAFRGGDRRGGKCRSGRGGGGRGGDGDGPGEGEMLRLAQTPRRLPSPFRVTYRPWGTRAFGAFPVFGTQISSPPENLDTAHLPHPEGAFEEWMRSGWKKRVIPFFERAETGRAVSREEHLFLLARFSPSGWRELPQVPIRGLAGAMIDSGAQLIKA

SEQ ID NO: 844605 - protein, 141 aa, Homo sapiens
PHLVTFLVHLFGQQPSGCSQPAPTLCFSSLCTFKCQRDRTPGALLSAQEAGPLCKPCSWCWALRSSPSSRALGNSAQGVLKVGALEARMSNNPSVARIGLHQHHSNCLYLLHPPLPPSARGGILRLGCGGGENDGFQKGLG

SEQ ID NO: 844606 - protein, 73 aa, Homo sapiens
SSSWMQRQDNASGLPKFLLPWISWCWVKMQPLSEAFLGLEPLTAVAVCQVEAGFLVKSLCIDGTLVLEEAGWK

SEQ ID NO: 844607 - protein, 724 aa, Homo sapiens
MDDDKPFQPKNISKMAELFMECEEEELEPWQKKVEETQDEDDDELIFVGEISSSKPAISNILNRGHSSSSSKGIKSEPHSPGIPEIFRTASQRCRDPPSNPVAASPRFHLVSKSSQSSVTVENASKPDFTKNSQVGSDNSSILLFDSTQESLPPSQDIPAIFREGMKNTSYVLKHPSTSKVNSVTPKKPKTSEDVPQINPSTSLPLIGSPPVTSSQVMLSKGTNTSSPYDAGADYLRACPKCNVQFNLLDPLKYHMKHCCPDMITKFLGVIVKSERPCDEDKTDSETGKLIMLVNEFYYGRHEGVTEKEPKTYTTFKCFSCSKVLKNNIRFMNHMKHHLELEKQNNESWENHTTCQHCYRQYPTPFQLQCHIESTHTPHEFSTICKICELSFETEHILLQHMKDTHKPGEMPYVCQVCQFRSSTFSDVEAHFRAAHENTKNLLCPFCLKVSKMATPYMNHYMKHQKKGVHRCPKCRLQFLTSKEKAEHKAQHRTFIKPKELEGLPPGAKVTIRASLGPLQSKLPTAPFGCAPGTSFLQVTPPTSQNTTARNPRKSNASRSKTSKLHATTSTASKVNTSKPRGRIAKSKAKPSYKQKRQRNRKNKMSLALKNIRCRRGIHKCIECHSKIKDFASHFSIYIHCSFCKYNTNCNKAFVNHMMSSHSNHPGKRFCIFKKHSGTLRGITLVCLKCDFLADSSGLDRMAKHLSQRKTHTCQVIIENGTYI

SEQ ID NO: 844608 - protein, 393 aa, Homo sapiens
MNHMKHHLELEKQNNESWENHTTCQHCYRQYPTPFQLQCHIESTHTPHEFSTICKICELSFETEHILLQHMKDTHKPGEMPYVCQVCQFRSSTFSDVEAHFRAAHENTKNLLCPFCLKVSKMATPYMNHYMKHQKKGVHRCPKCRLQFLTSKEKAEHKAQHRTFIKPKELEGLPPGAKVTIRASLGPLQSKLPTAPFGCAPGTSFLQVTPPTSQNTTARNPRKSNASRSKTSKLHATTSTASKVNTSKPRGRIAKSKAKPSYKQKRQRNRKNKMSLALKNIRCRRGIHKCIECHSKIKDFASHFSIYIHCSFCKYNTNCNKAFVNHMMSSHSNHPGKRFCIFKKHSGTLRGITLVCLKCDFLADSSGLDRMAKHLSQRKTHTCQVIIENGTYI

SEQ ID NO: 844609 - protein, 710 aa, Homo sapiens
MAELFMECEEEELEPWQKKVEETQDEDDDELIFVGEISSSKPAISNILNRGHSSSSSKGIKSEPHSPGIPEIFRTASQRCRDPPSNPVAASPRFHLVSKSSQSSVTVENASKPDFTKNSQVGSDNSSILLFDSTQESLPPSQDIPAIFREGMKNTSYVLKHPSTSKVNSVTPKKPKTSEDVPQINPSTSLPLIGSPPVTSSQVMLSKGTNTSSPYDAGADYLRACPKCNVQFNLLDPLKYHMKHCCPDMITKFLGVIVKSERPCDEDKTDSETGKLIMLVNEFYYGRHEGVTEKEPKTYTTFKCFSCSKVLKNNIRFMNHMKHHLELEKQNNESWENHTTCQHCYRQYPTPFQLQCHIESTHTPHEFSTICKICELSFETEHILLQHMKDTHKPGEMPYVCQVCQFRSSTFSDVEAHFRAAHENTKNLLCPFCLKVSKMATPYMNHYMKHQKKGVHRCPKCRLQFLTSKEKAEHKAQHRTFIKPKELEGLPPGAKVTIRASLGPLQSKLPTAPFGCAPGTSFLQVTPPTSQNTTARNPRKSNASRSKTSKLHATTSTASKVNTSKPRGRIAKSKAKPSYKQKRQRNRKNKMSLALKNIRCRRGIHKCIECHSKIKDFASHFSIYIHCSFCKYNTNCNKAFVNHMMSSHSNHPGKRFCIFKKHSGTLRGITLVCLKCDFLADSSGLDRMAKHLSQRKTHTCQVIIENGTYI

SEQ ID NO: 844610 - protein, 675 aa, Homo sapiens
MDDDKPFQPKNISKMAELFMECEEEELEPWQKKVEETQDEDDDELIFVGEISSSKPAISNILNRGHSSSSSKGIKSEPHSPGIPEIFRTASQRCRDPPSNPVAASPRFHLVSKSSQSSVTVENASKPDFTKNSQVGSDNSSILLFDSTQESLPPSQDIPAIFREGMKNTSYVLKHPSTSKVNSVTPKKPKTSEDVPQINPSTSLPLIGSPPVTSSQVMLSKGTNTSSPYDAGADYLRACPKCNVQFNLLDPLKYHMKHCCPDMITKFLGVIVKSERPCDEDKTDSETGKLIMLVNEFYYGRHEGVTEKEPKTYTTFKCFSCSKVLKNNIRFMNHMKHHLELEKQNNESWENHTTCQHCYRQYPTPFQLQCHIESTHTPHEFSTICKICELSFETEHILLQHMKDTHKPGEMPYVCQKKGVHRCPKCRLQFLTSKEKAEHKAQHRTFIKPKELEGLPPGAKVTIRASLGPLQSKLPTAPFGCAPGTSFLQVTPPTSQNTTARNPRKSNASRSKTSKLHATTSTASKVNTSKPRGRIAKSKAKPSYKQKRQRNRKNKMSLALKNIRCRRGIHKCIECHSKIKDFASHFSIYIHCSFCKYNTNCNKAFVNHMMSSHSNHPGKRFCIFKKHSGTLRGITLVCLKCDFLADSSGLDRMAKHLSQRKTHTCQVIIENGTYI

SEQ ID NO: 844611 - protein, 133 aa, Homo sapiens
MEAPQRQQATLGKNTQPDWSKVPGFRSQFRSSPKTSELLEGLCDAVMSFALLRSFLILWKQLEVLKEHWGRLKLQGQDINSVSLHKRFSELYETDVLYPSMKAIARQMGKEDEFEGFIVNNQSVLPPSGASEV

SEQ ID NO: 844612 - protein, 114 aa, Homo sapiens
MPRPASARARCAHPLTCAHCLALPREMNPVPQMEMQKSPSSASLTLGAVDQSCSYSAILAPYSHYLLELWLRHYNRAPSPLSKSWEMVIVNASPILEAPGCRGPQLAGCGGSGL

SEQ ID NO: 844613 - protein, 131 aa, Homo sapiens
MPRPASARARCAHPLTCAHCLALPREMNPVPQMEMQKSPSSASLTLGAVDQSCSYSAILAPYSHYLLELWLRHYNRAPSPLSKSWEMVIVNASPILEAPGCRGPQLDPSHPWSLTLDLSQKAEKRSSLESL

SEQ ID NO: 844614 - protein, 114 aa, Homo sapiens; identical to SEQ ID NO: 844612

SEQ ID NO: 844615 - protein, 341 aa, Homo sapiens
GAPGPPRCEHCGWALRISRFLPGFHSFAPCTVAPSLRAQPAKQRAPVAGVMQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 844616 - protein, 334 aa, Homo sapiens
KARYEAAVFIGRRVPGFHSFAPCTVAPSLRAQPAKQRAPVAGVMQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 844617 - protein, 347 aa, Homo sapiens
GAPGPPRCEHCGWALRISRFLPGFHSFAPCTVAPSLRAQPAKQRAPVAGVMQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGEPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 844618 - protein, 340 aa, Homo sapiens
GAPGPPRCEHCGWALRISRFLPGFHSFAPCTVAPSLRAQPAKQRAPVAGVMQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFGGGGGGGGGGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 844619 - protein, 341 aa, Homo sapiens; identical to SEQ ID NO: 844615

SEQ ID NO: 844620 - protein, 84 aa, Homo sapiens
SINYYSINYYSINYYSINYYSINYYSINYYSINYYSINYYSINYYSINYDQQLATASIYISVCGELIFFKPKFRKRFLKCLWFL

SEQ ID NO: 844621 - protein, 84 aa, Homo sapiens
PLPVQCAQGVGVKRVLYIGNTAAYVTKSVVGRFDQHVVSIHGRMKSRVLQCAQALSRIGKPLNPGHPDIPTHAPGAHSLLWCHF

SEQ ID NO: 844622 - protein, 307 aa, Homo sapiens
GAPGPPRCEHCGWALRISRFLPGFHSFAPCTVAPSLRAQPAKQRAPVAGVMQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKVLESRCLQSRRLAG

SEQ ID NO: 844623 - protein, 102 aa, Homo sapiens
RSAGSVESPSVSSTHRVSDPKFHPLHSKIIIIKKGHAKDSQRYKVDYESQSTDTQNFSSESKRETEYVRAFPLVKGGGQDLPSLGTQSLLRAILTQQTPAPG

SEQ ID NO: 844624 - protein, 341 aa, Homo sapiens; identical to SEQ ID NO: 844615

SEQ ID NO: 844625 - protein, 341 aa, Homo sapiens; identical to SEQ ID NO: 844615

SEQ ID NO: 844626 - protein, 301 aa, Homo sapiens
GAPGPPRCEHCGWALRISRFLPGFHSFAPCTVAPSLRAQPAKQRAPVAGVMQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYCRPSKGRKRGFCWCVDKYGQPLPGYTTKGKEDVHCYSMQSK

SEQ ID NO: 844627 - protein, 341 aa, Homo sapiens; identical to SEQ ID NO: 844615

SEQ ID NO: 844628 - protein, 341 aa, Homo sapiens; identical to SEQ ID NO: 844615

SEQ ID NO: 844629 - protein, 341 aa, Homo sapiens; identical to SEQ ID NO: 844615

SEQ ID NO: 844630 - protein, 107 aa, Homo sapiens
RLGTEAAVFIGRRVPGFHSFAPCTVAPSLRAQPAKQRAPVAGVMQRARPTLWAAALTLLVLLRGPPVARAGASSVGGLCVPVCAAVLMPVLTAASALVPMLLLHILP

SEQ ID NO: 844631 - protein, 336 aa, Homo sapiens [sequence omitted]

SEQ ID NO: 844632 - protein, 435 aa, Homo sapiens
MLRGPWRQLWLFLLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSTLQNGEGPGVHAPEDGVREYHSVGFHSTLDPAFQPLPSNLRGDIINEVVLKLLKAGWSREEITMEHLEPHLQAEIVETIDNGFGHSRLVKENLIDYFIPFLPLEYRHVRLCARDAFLSQELLYKEETLDEIAQMMVYVPKEEQLFSSQGCKSISQRINYFLS

SEQ ID NO: 844633 - protein, 397 aa, Homo sapiens
MLRGPWRQLWLFLLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINEVVLKLLKAGWSREEITMEHLEPHLQAEIVETIDNGFGHSRLVKENLIDYFIPFLPLEYRHVRLCARDAFLSQELLYKEETLDEIAQMMVYVPKEEQLFSSQGCKSISQRINYFLS

SEQ ID NO: 844634 - protein, 449 aa, Homo sapiens
MLRGPWRQLWLFLLLLLPGAPEPRGASRPWEGTDEPGSAWAWPGFQRLQEQLRAAGALSKRYWTLFSCQVWPDDCDEDEEAATGPLGLEDRQWAESGLGVENLSSGCPSVPDKLCGKVAASLYSTGWSPLGLTAPPFPGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINEVVLKLLKAGWSREEITMEHLEPHLQAEIVETIDNGFGHSRLVKENLIDYFIPFLPLEYRHVRLCARDAFLSQELLYKEETLDEIAQMMVYVPKEEQLFSSQGCKSISQRINYFLS

SEQ ID NO: 844635 - protein, 181 aa, Homo sapiens
MSQIRETQQLCHQTLFIFDEAEKLHPGLLEVLGPHLERRAPEGHRAESPWTIFLFLSNLRGDIINEVVLKLLKAGWSREEITMEHLEPHLQAEIVETIDNGFGHSRLVKENLIDYFIPFLPLEYRHVRLCARDAFLSQELLYKEETLDEIAQMMVYVPKEEQLFSSQGCKSISQRINYFLS

SEQ ID NO: 844636 - protein, 289 aa, Homo sapiens
MLRGPWRQLWLFLLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLRWVLGNNSQEGWGRGRY

SEQ ID NO: 844637 - protein, 281 aa, Homo sapiens
MLRGPWRQLWLFLLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNSQGRINF

SEQ ID NO: 844638 - protein, 397 aa, Homo sapiens; identical to SEQ ID NO: 844633

SEQ ID NO: 844639 - protein, 397 aa, Homo sapiens; identical to SEQ ID NO: 844633

SEQ ID NO: 844640 - protein, 397 aa, Homo sapiens; identical to SEQ ID NO: 844633

SEQ ID NO: 844641 - protein, 181 aa, Homo sapiens; identical to SEQ ID NO: 844635

SEQ ID NO: 844642 - protein, 146 aa, Homo sapiens [sequence omitted]

SEQ ID NO: 844643 - protein, 102 aa, Homo sapiens
HEGRGRGKKKKNNMSSGSGKVSLSRKLYLFNMISVASFFQCLSYAINILPFSYVNGTTLGSRTKVCISFFLQSCWVVLSNGTFYSISPSSLAPLVPSSHLCA

SEQ ID NO: 844644 - protein, 1036 aa, Homo sapiens
MPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHITNHYLGLCAALEPILSAKTKEEMASALVHILQSTGKVKDFLTDLMMSEVDRCGDNEHLIFRENTLATKAIEEYLKLVGQKYLQDALGEFIKALYESDENCEVDPSKCSAADLPEHQGNLKMCCELAFCKIINSYCVFPRELKEVFASWRQECSSRGRPDISERLISASLFLRFLCPAIMSPSLFNLLQEYPDDRTARTLTLIAKVTQNLANFAKFGSKEEYMSFMNQFLEHEWTNMQRFLLEISNPETLSNTAGFEGYIDLGRELSSLHSLLWEAVSQLEQSIVSKLGPLPRILRDVHTALSTPGSGQLPGTNDLASTPGSGSSSISAGLQKMVIENDLSGLIDFTRLPSPTPENKDLFFVTRSSGVQPSPARSSSYSEANEPDLQMANGGKSLSMVDLQDARTLDGEAGSPAGPDVLPTDGQAAAAQLVAGWPARATPVNLAGLATVRRAGQTPTTPGTSEGAPGRPQLLAPLSFQNPVYQMAAGLPLSPRGLGDSGSEGHSSLSSHSNSEELAAAAKLGSFSTAAEELARRPGELARRQMSLTEKGGQPTVPRQNSAGPQRRIDQPPPPPPPPPPAPRGRTPPNLLSTLQYPRPSSGTLASASPDWVGPSTRLRQQSSSSKGDSPELKPRAVHKQGPSPVSPNALDRTAAWLLTMNAQLLEDEGLGPDPPHRDRLRSKDELSQAEKDLAVLQDKLRISTKKLEEYETLFKCQEETTQKLVLEYQARLEEGEERLRRQQEDKDIQMKGIISRLMSVEEELKKDHAEMQAAVDSKQKIIDAQEKRIASLDAANARLMSALTQLKESMH

SEQ ID NO: 844645 - protein, 1065 aa, Homo sapiens
MPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHITNHYLGLCAALEPILSAKTKEEMASALVHILQSTGKVKDFLTDLMMSEVDRCGDNEHLIFRENTLATKAIEEYLKLVGQKYLQDALGEFIKALYESDENCEVDPSKCSAADLPEHQGNLKMCCELAFCKIINSYCVFPRELKEVFASWRQECSSRGRPDISERLISASLFLRFLCPAIMSPSLFNLLQEYPDDRTARTLTLIAKVTQNLANFAKFGSKEEYMSFMNQFLEHEWTNMQRFLLEISNPETLSNTAGFEGYIDLGRELSSLHSLLWEAVSQLEQSIVSKLGPLPRILRDVHTALSTPGSGQLPGTNDLASTPGSGSSSISAGLQKMVIENDLSGLIDFTRLPSPTPENKDLFFVTRSSGVQPSPARSSSYSEANEPDLQMANGGKSLSMVDLQDARTLDGEAGSPAGPDVLPTDGQAAAAQLVAGWPARATPVNLAGLATVRRAGQTPTTPGTSEGAPGRPQLLAPLSFQNPVYQMAAGLPLSPRGLGDSGSEGHSSLSSHSNSEELAAAAKLGSFSTAAEELARRPGELARRQMSLTEKGGQPTVPRQNSAGPQRRIDQPPPPPPPPPPAPRGRTPPNLLSTLQYPRPSSGTLASASPDWVGPSTRLRQQSSSSKGDSPELKPRAVHKQGPSPVSPNALDRTAAWLLTMNAQLLEDEGLGPDPPHRDRLRSKDELSQAEKDLAVLQDKLRISTKKLEEYETLFKCQEETTQKLVLEYQARLEEGEERLRRQQEDKDIQMKGIISRLMSVEEELKKDHAEMQAAVDSKQKIIDAQEKRIASLDAANARLMSALTQLKERYSMQARNGISPTNPTKLQITENGEFRNSSNC

SEQ ID NO: 844646 - protein, 1065 aa, Homo sapiens; identical to SEQ ID NO: 844645

SEQ ID NO: 844647 - protein, 1065 aa, Homo sapiens; identical to SEQ ID NO: 844645

SEQ ID NO: 844648 - protein, 388 aa, Homo sapiens
MPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHITNHYLGLCAALEPILSAKTKEEMASALVHILQSTGKVKDFLTDLMMSEVDRCGDNEHLIFRENTLATKAIEEYLKLVGQKYLQDALGEFIKALYESDENCEVDPSKCSAGCAPGQMPSPPWSWHRGWARGLHTAPGSGGDVLSELFVHLHGQDGDGLVTH

SEQ ID NO: 844649 - protein, 1065 aa, Homo sapiens; identical to SEQ ID NO: 844645

SEQ ID NO: 844650 - protein, 986 aa, Homo sapiens
MPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHITNHYLGLCAALEPILSAKTKEEMASALVHILQSTGKVKDFLTDLMMSEVDRCGDNEHLIFRENTLATKAIEEYLKLVGQKYLQDALGEFIKALYESDENCEVDPSKCSAADLPEHQGNLKMCCELAFCKIINSYCFGSKEEYMSFMNQFLEHEWTNMQRFLLEISNPETLSNTAGFEGYIDLGRELSSLHSLLWEAVSQLEQSIVSKLGPLPRILRDVHTALSTPGSGQLPGTNDLASTPGSGSSSISAGLQKMVIENDLSGLIDFTRLPSPTPENKDLFFVTRSSGVQPSPARSSSYSEANEPDLQMANGGKSLSMVDLQDARTLDGEAGSPAGPDVLPTDGQAAAAQLVAGWPARATPVNLAGLATVRRAGQTPTTPGTSEGAPGRPQLLAPLSFQNPVYQMAAGLPLSPRGLGDSGSEGHSSLSSHSNSEELAAAAKLGSFSTAAEELARRPGELARRQMSLTEKGGQPTVPRQNSAGPQRRIDQPPPPPPPPPPAPRGRTPPNLLSTLQYPRPSSGTLASASPDWVGPSTRLRQQSSSSKGDSPELKPRAVHKQGPSPVSPNALDRTAAWLLTMNAQLLEDEGLGPDPPHRDRLRSKDELSQAEKDLAVLQDKLRISTKKLEEYETLFKCQEETTQKLVLEYQARLEEGEERLRRQQEDKDIQMKGIISRLMSVEEELKKDHAEMQAAVDSKQKIIDAQEKRIASLDAANARLMSALTQLKERYSMQARNGISPTNPTKLQITENGEFRNSSNC

SEQ ID NO: 844651 - protein, 1065 aa, Homo sapiens; identical to SEQ ID NO: 844645

SEQ ID NO: 844652 - protein, 416 aa, Homo sapiens
MPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHITNHYLGLCAALEPILSAKTKEEMASALVHILQSTGKVKDFLTDLMMSEVDRCGDNEHLIFRENTLATKAIEEYLKLVGQKYLQDALGEFIKALYESDENCEVDPSKCSAADLPEHQGNLKMCCELAFCKIINSYCVFPRELKEVFASWRQECSSRGRPDISERLISASLFLRFLCPAIMSPLPASTEA

SEQ ID NO: 844653 - protein, 70 aa, Homo sapiens
RSLSHDPRSHPHCPQEKRIASLDAANARLMSALTQLKERYSMQARNGISPTNPTKLQITENGEFRNSSNC

SEQ ID NO: 844654 - protein, 144 aa, Homo sapiens
MEFPGGNDNYLTITGPSHPFLSGAETFHTPSLGDEEFEIPPISLDSDPSLAVSDVVGHFDDLADPSSSQDGSFSAQYGVQTLDMPVGMTHGLMEQGGGLLSGGLTMVRGKTLSGLPQLMGMALGETKLLYSLLHLGITCFSSCG

SEQ ID NO: 844655 - protein, 538 aa, Homo sapiens [sequence omitted]

SEQ ID NO: 844656 - protein, 544 aa, Homo sapiens
MEFPGGNDNYLTITGPSHPFLSGAETFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRRQLPSQKTVVVEAGKKQKAPKKRKKKDPNEPQKPVSAYALFFRDTQAAIKGQNPNATFGEVSKIVASMWDSLGEEQKQVYKRKTEAAKKEYLKALAAYKDNQECQATVETVELDPAPPSQTPSPPPMATVDPASPAPASIEPPALSPSIVVNSTLSSYVANQASSGAGGQPNITKLIITKQMLPSSITMSQGGMVTVIPATVVTSRGLQLGQTSTATIQPSQQAQIVTRSVLQAAAAAAAAASMQLPPPRLQPPPLQQMPQPPTQQQVTILQQPPPLQAMQQPPPQKVRINLQQQPPPLQIKSVPLPTLKMQTTLVPPTVESSPERPMNNSPEAHTVEEQVTRKEYEKGLEI

SEQ ID NO: 844657 - protein, 317 aa, Homo sapiens
MEFPGGNDNYLTITGPSHPFLSGAETFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRRQLPSQKTVVVEAGKKQKAPKKRKKKDPNEPQKPVSAYALFFRDTQAAIKGQNPNATFGEVSKIVASMWDSLGEEQKQVYKRKTEAAKKEYLKALAAYKDNQECQATVETSGIGSSTMSFLLPCK

SEQ ID NO: 844658 - protein, 621 aa, Homo sapiens
MEFPGGNDNYLTITGPSHPFLSGAETFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRRQLPSQKTVVVEAGKKQKAPKKRKKKDPNEPQKPVSAYALFFRDTQAAIKGQNPNATFGEVSKIVASMWDSLGEEQKQVYKRKTEAAKKEYLKALAAYKDNQECQATVETVELDPAPPSQTPSPPPMATVDPASPAPASIEPPALSPSIVVNSTLSSYVANQASSGAGGQPNITKLIITKQMLPSSITMSQGGMVTVIPATVVTSRGLQLGQTSTATIQPSQQAQIVTRSVLQAAAAAAAAASMQLPPPRLQPPPLQQMPQPPTQQQVTILQQPPPLQAMQQPPPQKVRINLQQQPPPLQIKSVPLPTLKMQTTLVPPTVESSPERPMNNSPEAHTVEAPSPETICEMITDVVPEVESPSQMDVELVSGSPVALSPQPRCVRSGCENPPIVSKDWDNEYCSNECVVKHCRDVFLAWVASRNSNTVVFVK

SEQ ID NO: 844659 - protein, 621 aa, Homo sapiens; identical to SEQ ID NO: 844658

SEQ ID NO: 844660 - protein, 621 aa, Homo sapiens; identical to SEQ ID NO: 844658

SEQ ID NO: 844661 - protein, 494 aa, Homo sapiens [sequence omitted]

SEQ ID NO: 844662 - protein, 494 aa, Homo sapiens [sequence omitted]

SEQ ID NO: 844663 - protein, 602 aa, Homo sapiens
MEFPGGNDNYLTITGPSHPFLSGAETFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRRQLPSQKTVVVEAGKKQKAPKKRKKKDPNEPQKPVSAYALFFRDTQAAIKGQNPNATFGEVSKIVASMWDSLGEEQKQVYKRKTEAAKKEYLKALAAYKDNQECQATVETVELDPAPPSQTPSPPPMATVDPASPAPASIEPPALSPSIVVNSTLSSYVANQASSGAGGQPNITKLIITKQMLPSSITMSQGGMVTVIPATVVTSRGLQLGQTSTATIQPSQQAQIVTRSVLQAAAAAAAAASMQLPPPRLQPPPLQQMPQPPTQQQVTILQQPPPLQAMQQPPPQKVRINLQQQPPPLQIKSVPLPTLKMQTTLVPPTVESSPERPMNNSPEAHTVEAPSPETICEMITDVVPEVESPSQMDVELVSGSPVALSPQPRCVRSGCENPPIVSKDWDNEYCSNECVVKHCR

SEQ ID NO: 844664 - protein, 376 aa, Homo sapiens
MEFPGGNDNYLTITGPSHPFLSGAETFHTPSLGDEEFEIPPISLDSDPSLAVSDVVGHFDDLADPSSSQDGSFSAQYGVQTLDMPVGMTPALSPSIVVNSTLSSYVANQASSGAGGQPNITKLIITKQMLPSSITMSQGGMVTVIPATVVTSRGLQLGQTSTATIQPSQQAQIVTRSVLQAAAAAAAAASMQLPPPRLQPPPLQQMPQPPTQQQVTILQQPPPLQAMQQPPPQKVRINLQQQPPPLQIKSVPLPTLKMQTTLVPPTVESSPERPMNNSPEAHTVEAPSPETICEMITDVVPEVESPSQMDVELVSGSPVALSPQPRCVRSGCENPPIVSKDWDNEYCSNECVVKHCRDVFLAWVASRNSNTVVFVK

SEQ ID NO: 844665 - protein, 367 aa, Homo sapiens
MEFPGGNDNYLTITGPSHPFLSGAETFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRRQLPSQKTVVVEAGKKQKAPKKRKKKDPNEPQKPVSAYALFFRDTQAAIKGQNPNATFGEVSKIVASMWDSLGEEQKQVYKRKTEAAKKEYLKALAAYKDNQECQATVETVELDPAPPSQTPSPPPMATVDPASPAPASIEPPALSPSLLKLQKITQTWCPALQPGRRSKTVSKQ

SEQ ID NO: 844666 - protein, 683 aa, Homo sapiens
MALSKRELDELKPWIEKTVKRVLGFSEPTVVTAALNCVGKGMDKKKAADHLKPFLDDSTLRFVDKLFEAVEEGRSSRHSKSSSDRSRKRELKEVFGDDSEISKESSGVKKRRIPRFEEVEEEPEVIPGPPSESPGMLTKLQIKQMMEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQKAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 844667 - protein, 683 aa, Homo sapiens; identical to SEQ ID NO: 844666

SEQ ID NO: 844668 - protein, 120 aa, Homo sapiens
MALSKRELDELKPWIEKTVKRVLGFSEPTVVTAALNCVGKGMDKKKAADHLKPFLDDSTLRFVDKLFEAVEEGRSSRHSKSSSDRSRKRELKEVFGDDSEISKESSGVKKRRIPRFEEVE

SEQ ID NO: 844669 - protein, 683 aa, Homo sapiens; identical to SEQ ID NO: 844666

SEQ ID NO: 844670 - protein, 715 aa, Homo sapiens
MALSKRELDELKPWIEKTVKRVLGFSEPTVVTAALNCVGKGMDKKKAADHLKPFLDDSTLRFVDKLFEAVEEGRSSRHSKSSSDRSRKRELKEFQEALAPGRGYVLAKHEPSYEEGMSPKAYHLEVFGDDSEISKESSGVKKRRIPRFEEVEEEPEVIPGPPSESPGMLTKLQIKQMMEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQKAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 844671 - protein, 488 aa, Homo sapiens
MNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQKAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 844672 - protein, 634 aa, Homo sapiens
MALSKRELDELKPWIEKTVKRVLGFSEPTVVTAALNCVGKGMDKKKAADHLKPFLDDSTLRFVDKLFEAVEEGRSSRHSKSSSDRSRKRELKIKQMMEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQKAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 844673 - protein, 538 aa, Homo sapiens
MEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQKAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 844674 - protein, 604 aa, Homo sapiens [sequence omitted]

SEQ ID NO: 844675 - protein, 447 aa, Homo sapiens
SCFCLWLCSPASLCFLLLPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQKAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 844676 - protein, 440 aa, Homo sapiens
MALSKRELDELKPWIEKTVKRVLGFSEPTVVTARMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQKAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 844677 - protein, 683 aa, Homo sapiens; identical to SEQ ID NO: 844666

SEQ ID NO: 844678 - protein, 492 aa, Homo sapiens
MALSKRELDELKPWIEKTVKRVLGFSEPTVVTAALNCVGKGMDKKKAADHLKPFLDDSTLRFVDKLFEAVEEGRSSRHSKSSSDRSRKRELKEVFGDDSEISKESSGVKKRRIPRFEEVEEEPEVIPGPPSESPGMLTKLQIKQMMEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISKFDADSFEGILLE

SEQ ID NO: 844679 - protein, 702 aa, Homo sapiens
MALSKRELDELKPWIEKTVKRVLGFSEPTVVTAALNCVGKGMDKKKAADHLKPFLDDSTLRFVDKLFEAVEEGRSSRHSKSSSDRSRKRELKEVFGDDSEISKESSGVKKRRIPRFEEVEEEPEVIPGPPSESPGMLTKLQIKQMMEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQNPASDLQCLSHLWMSFLHDRAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 844680 - protein, 683 aa, Homo sapiens; identical to SEQ ID NO: 844666

SEQ ID NO: 844681 - protein, 260 aa, Homo sapiens
MALSKRELDELKPWIEKTVKRVLGFSEPTVVTAALNCVGKGMDKKKAADHLKPFLDDSTLRFVDKLFEAVEEGRSSRHSKSSSDRSRKRELKEVFGDDSEISKESSGVKKRRIPRFEEVEEEPEVIPGPPSESPGMLTKLQIKQMMEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPREHGS

SEQ ID NO: 844682 - protein, 202 aa, Homo sapiens
MCRTLAAFPTTCLERAKEFKTRLGIFLHKSELGCDTGSTGKFEWGSKHSKENRNFSEDVLGWRESFDLLLSSKNGVAAFHAFLKTEFSEENLEFWLACEEFKKIRSATKLASRAHQIFEEFICSEAPKEVNIDHETRELTRMNLQTATATCFDAAQGKTRTLMEKDSYPRFLKSPAYRDLAAQASAASATLSSCSLDEPSHT

SEQ ID NO: 844683 - protein, 202 aa, Homo sapiens; identical to SEQ ID NO: 844682

SEQ ID NO: 844684 - protein, 160 aa, Homo sapiens
MCRTLAAFPTTCLERAKEFKTRLGIFLHKSELGCDTGSTGKFEWGSKHSKENRNFSEDVLGWRESFDLLLSSKNGVAAFHAFLKTEFSEENLEFWLACEEFKKIRSATKLASRAHQIFEEFICSEAPKEVNIDHETRELTRMNLQTATLSSCSLDEPSHT

SEQ ID NO: 844685 - protein, 143 aa, Homo sapiens [sequence omitted]

SEQ ID NO: 844686 - protein, 143 aa, Homo sapiens [sequence omitted]

SEQ ID NO: 844687 - protein, 202 aa, Homo sapiens; identical to SEQ ID NO: 844682

SEQ ID NO: 844688 - protein, 238 aa, Homo sapiens
QFCCKEVFCTQAHFCTQAHFCTQAHFCTQAHFCTQAHFCTQAHFSTTCLERAKEFKTRLGIFLHKSELGCDTGSTGKFEWGSKHSKENRNFSEDVLGWRESFDLLLSSKNGVAAFHAFLKTEFSEENLEFWLACEEFKKIRSATKLASRAHQIFEEFICSEAPKEVNIDHETRELTRMNLQTATATCFDAAQGKTRTLMEKDSYPRFLKSPAYRDLAAQASAASATLSSCSLDEPSHT

SEQ ID NO: 844689 - protein, 143 aa, Homo sapiens [sequence omitted]

SEQ ID NO: 844690 - protein, 180 aa, Homo sapiens
MCRTLAAFPTTCLERAKEFKTRLGIFLHKSELGCDTGSTGKFEWGSKHSKENRNFSEDVLGWRESFDLLLSSKNGVAAFHAFLKTEFSEENLEFWLACEEFKKIRSATKLASRAHQIFEEFICSEAPKEVNIDHETRELTRMNLQTATATCFDAAQGKTRTLMEKDSYPRSQVPVSRRRR

SEQ ID NO: 844691 - protein, 56 aa, Homo sapiens
MALKPKVRHVQDATVTKFTPSRMHLTLEADEANDANVYPGSLRSAPNISPSASAGF

SEQ ID NO: 844692 - protein, 30 aa, Homo sapiens
MPTGYLPGGPGPVLTTALNGHHREWSPSSQ

SEQ ID NO: 844693 - protein, 417 aa, Homo sapiens
QWYQRRGHYGRGGQCHLQDTDSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNHENLKGGDDLDPNYVLSSRVRTGRSIKGYTLPPHCSRGERRAVEKLSVEALNSLTGEFKGKYYPLKSMTEKEQQQLIDDHFLFDKPVSPLLLASGMARDWPDARGIWHNDNKSFLVWVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 844694 - protein, 312 aa, Homo sapiens [sequence omitted]

SEQ ID NO: 844695 - protein, 304 aa, Homo sapiens
MFNGREIFKELFDPIISDRHGGYKPTDKHKTDLNHENLKGGDDLDPNYVLSSRVRTGRSIKGYTLPPHCSRGERRAVEKLSVEALNSLTGEFKGKYYPLKSMTEKEQQQLIDDHFLFDKPVSPLLLASGMARDWPDARGIWHNDNKSFLVWVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 844696 - protein, 272 aa, Homo sapiens
FFEENLKGGDDLDPNYVLSSRVRTGRSIKGYTLPPHCSRGERRAVEKLSVEALNSLTGEFKGKYYPLKSMTEKEQQQLIDDHFLFDKPVSPLLLASGMARDWPDARGIWHNDNKSFLVWVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 844697 - protein, 277 aa, Homo sapiens
RVQVVSTLEVFMVEVSLVLVSGFVSRVRTGRSIKGYTLPPHCSRGERRAVEKLSVEALNSLTGEFKGKYYPLKSMTEKEQQQLIDDHFLFDKPVSPLLLASGMARDWPDARGIWHNDNKSFLVWVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 844698 - protein, 417 aa, Homo sapiens; identical to SEQ ID NO: 844693

SEQ ID NO: 844699 - protein, 245 aa, Homo sapiens
QWYQRRGHYGRGGQCHLQDTDSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNHENLKGGDDLDPNYVLSSRVRTGRSIKGYTLPPHCSRGERRAVEKLSVEALNSAKTEIREKLAQMSDTRMSILCWIRTLWWCRHCFADYDPGVQENDH

SEQ ID NO: 844700 - protein, 184 aa, Homo sapiens
QWYQRRGHYGRGGQCHLQDTDSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNHENLKQWAPSSGFWPMKYLPGRVLFFSQSSTPTRSSS

SEQ ID NO: 844701 - protein, 292 aa, Homo sapiens
LEWSKNETVIEKPTDKHKTDLNHENLKGGDDLDPNYVLSSRVRTGRSIKGYTLPPHCSRGERRAVEKLSVEALNSLTGEFKGKYYPLKSMTEKEQQQLIDDHFLFDKPVSPLLLASGMARDWPDARGIWHNDNKSFLVWVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 844702 - protein, 132 aa, Homo sapiens
LGAFCVGLQKIEEIFKKAGHPFMWNQHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 844703 - protein, 285 aa, Homo sapiens
QWYQRRGHYGRGGQCHLQDTDSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNHENLKGGDDLDPNYVLSSRVRTGRSIKGYTLPPHCSRGERRAVEKLSVEALNSLTGEFKGKYYPLKSMTEKEQQQLIDDHFLFDKPVSPLLLASGMAGWPSRGLAMTPELRGVTRGPPGTPREGHTKRQRRREMGKRT

SEQ ID NO: 844704 - protein, 68 aa, Homo sapiens
SSIFPSCPAHQVSYTATMPFGNTHNKFKLNYKPEEEYPDLSKHNNHMAKVLTLELYKKLRDKETPSGF

SEQ ID NO: 844705 - protein, 151 aa, Homo sapiens
ICSSLTRVGSKSVCVYLCLYVSVCICVCRRLVEMSTWTFPRVTKTWDRLMLQDNCCGVNGPSDWQKYTSAFRTENNDADYPWPRQCCVMNNLKEPLNLEACKLGVPGFYHNQGCYELISGPMNRHAWGVAWFGFAILCWTFWVLLGTMVLL

SEQ ID NO: 844706 - protein, 282 aa, Homo sapiens
ERALPCAQKEEALAFSLWEIPKMAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQRDFFTPNLFLKQMLERYQNNSPPNNDDQWKNNGVTKTWDRLMLQDNCCGVNGPSDWQKYTSAFRTENNDADYPWPRQCCVMNNLKEPLNLEACKLGVPGFYHNQGCYELISGPMNRHAWGVAWFGFAILCWTFWVLLGTMFYWSRIEY

SEQ ID NO: 844707 - protein, 260 aa, Homo sapiens
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQRDFFTPNLFLKQMLERYQNNSPPNNDDQWKNNGVTKTWDRLMLQDNCCGVNGPSDWQKYTSAFRTENNDADYPWPRQCCVMNNLKEPLNLEACKLGVPGFYHNQGCYELISGPMNRHAWGVAWFGFAILCWTFWVLLGTMFYWSRIEY

SEQ ID NO: 844708 - protein, 432 aa, Homo sapiens
MAHLMMFRDVAVDFSQEEWECLDLEQRDLYRDVMLENYSNMVSLGFCIYQPEAFSLLEKGKEPWKILRDETRGPCPDMQSRCQTKKLLPKNGIFEREIAQLEIMRICKNHSLDCLCFRGDWEGNTQFQTLQDNQEECFKQVIRTCEKRPTFNQHTVFNLHQRLNTGDKLNEFKELGKAFISGSDHTQHQLIHTSEKFCGDKECGNTFLPDSEVIQYQTVHTVKKTYECKECGKSFSLRSSLTGHKRIHTGEKPFKCKDCGKAFRFHSQLSVHKRIHTGEKSYECKECGKAFSCGSDLTRHQRIHTGEKPYECNECRKAFSQRSHLIKHQRIHTGEKPYECKECGKAFTRGSHLTQHQRIHTGEKSHECKECGKAFIRGSNLAQHQNVHVGRKPYKCEKCGKAYIWSSHLARHQRIHTGRKPYECKQCGKTFT

SEQ ID NO: 844709 - protein, 110 aa, Homo sapiens
MFLPSYFSDMQSRCQTKKLLPKNGIFEREIAQLEIMRICKNHSLDCLCFRGDWEGNTQFQTLQDNQEECFKQVIRTCEKRPTFNQHTVFNLHQRLNTGDKLNEFKELGKA

SEQ ID NO: 844710 - protein, 355 aa, Homo sapiens
MQSRCQTKKLLPKNGIFEREIAQLEIMRICKNHSLDCLCFRGDWEGNTQFQTLQDNQEECFKQVIRTCEKRPTFNQHTVFNLHQRLNTGDKLNEFKELGKAFISGSDHTQHQLIHTSEKFCGDKECGNTFLPDSEVIQYQTVHTVKKTYECKECGKSFSLRSSLTGHKRIHTGEKPFKCKDCGKAFRFHSQLSVHKRIHTGEKSYECKECGKAFSCGSDLTRHQRIHTGEKPYECNECRKAFSQRSHLIKHQRIHTGEKPYECKECGKAFTRGSHLTQHQRIHTGEKSHECKECGKAFIRGSNLAQHQNVHVGRKPYKCEKCGKAYIWSSHLARHQRIHTGRKPYECKQCGKTFT

SEQ ID NO: 844711 - protein, 255 aa, Homo sapiens
EVLDEVLLCSEPQFPHLNQGDAWQELVRADLEDLGCPAHSLPGVMIALACSARPLPVLSAILTVLLDWHCYACLQMSKLRLEGGGPGSWKWANSNPALSSVPCPVPSMGCPACHLTSSVWHVSGTGPGTPRWGRNGSALPGCSVMGRQLRAPSWVRRSPGENCQHLLARDVGLPLCQALVEAEDGNPDRVLELLLPIRYRIVQLGGSNAQVSRWPPAGVPRAWARESGRPAAPKFLPWCWCQQCGCERVSHTPAV

SEQ ID NO: 844712 - protein, 102 aa, Homo sapiens
MKAEIKDGLEFMQHSETLWKDSDMLACHNYWHWALYLIEKGEYEAALTIYDTHVSCIHTVFGLLQHFAFESQRDQIFEFIRIVPARKTAGARTHFLCKASWG

SEQ ID NO: 844713 - protein, 495 aa, Homo sapiens
PFRDRPAHSQEGPGAQSSRWTPTRRNMAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGNFPKACELWEQILQDHPTDMLALKFSHDAYFYLGYQEQMRDSVARIYPFWTPDIPLSSYVKGIYSFGLMETNFYDQAEKLAKEALSINPTDAWSVHTVAHIHEMKAEIKDGLEFMQHSETLWKDSDMLACHNYWHWALYLIEKGEYEAALTIYDTHILPSLQANDAMLDVVDSCSMLYRLQMEGVSVGQRWQDVLPVARKHSRDHILLFNDAHFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVARSLLMERDALKPNSPLTERLIRKAATVHLMQ

SEQ ID NO: 844714 - protein, 400 aa, Homo sapiens [sequence omitted]

SEQ ID NO: 844715 - protein, 437 aa, Homo sapiens
PFRDRPAHSQEGPGAQSSRWTPTRRNMAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGYVKGIYSFGLMETNFYDQAEKLAKEALSINPTDAWSVHTVAHIHEMKAEIKDGLEFMQHSETLWKDSDMLACHNYWHWALYLIEKGEYEAALTIYDTHILPSLQANDAMLDVVDSCSMLYRLQMEGVSVGQRWQDVLPVARKHSRDHILLFNDAHFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVARSLLMERDALKPNSPLTERLIRKAATVHLMQ

SEQ ID NO: 844716 - protein, 244 aa, Homo sapiens
MKAEIKDGLEFMQHSETLWKDSDMLACHNYWHWALYLIEKGEYEAALTIYDTHILPSLQANDAMLDVVDSCSMLYRLQMEGVSVGQRWQDVLPVARKHSRDHILLFNDAHFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVARSLLMERDALKPNSPLTERLIRKAATVHLMQ

SEQ ID NO: 844717 - protein, 495 aa, Homo sapiens; identical to SEQ ID NO: 844713

SEQ ID NO: 844718 - protein, 353 aa, Homo sapiens
PFRDRPAHSQEGPGAQSSRWTPTRRNMAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGNFPKACELWEQILQDHPTDMLALKFSHDAYFYLGYQEQMRDSVARIYPFWTPDIPLSSYVKGIYSFGLMETNFYDQAEKLAKEALSINPTDAWSVHTVAHIHEMKAEIKDGLEFMQHSETLWKDSDMLACHNYWHWALYLIEKGEYEAALTIYDTHVSCIHTVFGLLQHFAFESQRDQIFEFIRIVPARKTAGARTHFLCKASWG

SEQ ID NO: 844719 - protein, 495 aa, Homo sapiens; identical to SEQ ID NO: 844713

SEQ ID NO: 844720 - protein, 479 aa, Homo sapiens
PFRDRPAHSQEGPGAQSSRWTPTRRNMAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGNFPKACELWEQILQDHPTDMLALKFSHDAYFYLGYQEQMRDSVARIYPFWTPDIPLSSYVKGIYSFGLMETNFYDQAEKLAKEALSINPTDAWSVHTVAHIHEMKAEIKDGLEFMQHSETLWKDSDMLACHNYWHWALYLIEKGEYEAALTIYDTHILPSLQANDAMLDVVDSCSMLYRLQMEGVSVGQRWQDVLPVARKHSRDHILLFNDAHFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVARGKVSLGHPGWNAVV

SEQ ID NO: 844721 - protein, 495 aa, Homo sapiens; identical to SEQ ID NO: 844713

SEQ ID NO: 844722 - protein, 400 aa, Homo sapiens [sequence omitted]

SEQ ID NO: 844723 - protein, 255 aa, Homo sapiens
MPPRHRPSTSERRWRPETMCSGVFGLAVLSSRASITLCLLQGLIRRTLFFQGEYEAALTIYDTHILPSLQANDAMLDVVDSCSMLYRLQMEGVSVGQRWQDVLPVARKHSRDHILLFNDAHFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVARSLLMERDALKPNSPLTERLIRKAATVHLMQ

SEQ ID NO: 844724 - protein, 465 aa, Homo sapiens
PFRDRPAHSQEGPGAQSSRWTPTRRNMAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGNFPKACELWEQILQDHPTDMLALKFSHDAYFYLGYQEQMRDSVARIYPFWTPDIPLSSYVKGIYSFGLMETNFYDQAEKLAKEALSINPTDAWSVHTVAHIHEMKAEIKDGLEFMQHSETLWKDSDMLACHNYWHWALYLIEKGEYEAALTIYDTHILPSLQANDAMLDVVDSCSMLYRLQMEGVSVGQRWQDVLPVARKHSRDHILLFNDAHFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVAR

SEQ ID NO: 844725 - protein, 284 aa, Homo sapiens
PFRDRPAHSQEGPGAQSSRWTPTRRNMAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGNFPKACELWEQILQDHPTDMLALKFSHDAYFYLGYQEQMRDSVARIYPFWTPDIPLSSYVKGIYSFGLMETNFYDQAEKLAKEALSINPTDAWSVHTVAHIHEMKAEIKDGLEFMQHSETLWKGLVRRSEQPLQST

SEQ ID NO: 844726 - protein, 128 aa, Homo sapiens
MATAQLSHCITIHKASKETVFPSQITNEHESLKMVKKLFATSISCITYLRGLFPESSYGERHLDDLSLKILREDKKCPGSLHIIRWIQGCFDALEKRYVRMFLHLHWNQRLVFYSLKKEIRHLFCFCV

SEQ ID NO: 844727 - protein, 307 aa, Homo sapiens
MATAQLSHCITIHKASKETVFPSQITNEHESLKMVKKLFATSISCITYLRGLFPESSYGERHLDDLSLKILREDKKCPGSLHIIRWIQGCFDALEKRYLRMAVLTLYTDPMGSEKVTEMYQFKFKYTKEGATMDFDSHSSSTSFESGTNNEDIKKASVLLIRKLYILMQDLEPLPNNVVLTMKLHYYNAVTPHDYQPLGFKEGVNSHFLLFDKEPINVQVGFVSTGFHSMKVKVMTEATKVIDLENNLFRENSTTEIAHQGLDCDEEEECNDHIQRMNFVCSQQSSECSRKKRKVSEPVKVFIPNRK

SEQ ID NO: 844728 - protein, 219 aa, Homo sapiens
MSRVTAYYQMVSNRNSILYTDPMGSEKVTEMYQFKFKYTKEGATMDFDSHSSSTSFESGTNNEDIKKASVLLIRKLYILMQDLEPLPNNVVLTMKLHYYNAVTPHDYQPLGFKEGVNSHFLLFDKEPINVQVGFVSTGFHSMKVKVMTEATKVIDLENNLFRENSTTEIAHQGLDCDEEEECNDHIQRMNFVCSQQSSECSRKKRKVSEPVKVFIPNRK

SEQ ID NO: 844729 - protein, 92 aa, Homo sapiens
LGVHVKKVSCIGKLGPWRFVIQIISSPRWESSATLRFTDAPCQDVSDAAVSEPRGLLSVSESQHNAGGHGVFGGRYLLNGKRQPAQCLCHWF

SEQ ID NO: 844730 - protein, 1408 aa, Homo sapiens
MPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASPPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLATPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGGKAVPLSASQMPPAKMSVMLPSVNLEDCSQSLSLSTMQEDMESSGADTF

SEQ ID NO: 844731 - protein, 1386 aa, Homo sapiens
MPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASPPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLATPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQGGKAVPLSASQMPPAKMSVMLPSVNLEDCSQSLSLSTMQEDMESSGADTF

SEQ ID NO: 844732 - protein, 1364 aa, Homo sapiens
MPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASPPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLATPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGGKAVPLSASQMPPAKMSVMLPSVNLEDCSQSLSLSTMQEDMESSGADTF

SEQ ID NO: 844733 - protein, 1337 aa, Homo sapiens
MPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASPPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLATPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQG

SEQ ID NO: 844734 - protein, 75 aa, Homo sapiens
IISQSIKHVNTQVTHVELNELLLCAGGKAVPLSASQMPPAKMSVMLPSVNLEDCSQSLSLSTMQEDMESSGADTF

SEQ ID NO: 844735 - protein, 1533 aa, Homo sapiens [sequence omitted]

SEQ ID NO: 844736 - protein, 1408 aa, Homo sapiens; identical to SEQ ID NO: 844730

SEQ ID NO: 844737 - protein, 1311 aa, Homo sapiens
MPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASPPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLATPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPRGLLSVSESQHNAGGHGVFGGRYLLNGKRQPAQCLCHWF

SEQ ID NO: 844738 - protein, 1347 aa, Homo sapiens [sequence omitted]

SEQ ID NO: 844739 - protein, 92 aa, Homo sapiens; identical to SEQ ID NO: 844729

SEQ ID NO: 844740 - protein, 102 aa, Homo sapiens
LGTVLRWICRLQECMLIWLPCSTTSGLLSMGAAPTIILVPSLCAKGSPAFRTGHLCSLSFSPSLHLAWALEVLTSQYILECAPVCHASVPLFFKASGISRIT

SEQ ID NO: 844741 - protein, 179 aa, Homo sapiens
KGPPSGYAVMQKERMDSRWSACREVCSQHTHRDQDTHKHVYPFIHKQTRPHKLTGQEKQRHRYIHRHTNIHTFKCTSADGHRPGHTPAMTHTCRGTYVHVNPRHTHTRPESIYFEAQTEGAAHRNTAEISSSALELPPAGRVTPGVMSPFCASILSSAKRDDNGLSLIGCGAGDMSHFT

SEQ ID NO: 844742 - protein, 170 aa, Homo sapiens
GQDDILGSSLSKWGEVCSQHTHRDQDTHKHVYPFIHKQTRPHKLTGQEKQRHRYIHRHTNIHTFKCTSADGHRPGHTPAMTHTCRGTYVHVNPRHTHTRPESIYFEAQTEGAAHRNTAEISSSALELPPAGRVTPGVMSPFCASILSSAKRDDNGLSLIGCGAGDMSHFT

SEQ ID NO: 844743 - protein, 74 aa, Homo sapiens
MWNLLHETDSAVATARRPRWLCAGALVLAGGFFLLGFLFGWFIKSSNEATNITPKHNMKAFLDELKAENIKKFL

SEQ ID NO: 844744 - protein, 270 aa, Homo sapiens
MVTAMNVSHEVNQLFQPYNFELSKDMRPFFEEYWATSFPIALIYLVLIAVGQNYMKERKGFNLQGPLILWSFCLAIFSILGAVRMWGIMGTVLLTGGLKQTVCFINFIDNSTVKFWSWVFLLSKVIELGDTAFIILRKRPLIFIHWYHHSTVLVYTSFGYKNKVPAGGWFVTMNFGVHAIMYTYYTLKAANVKPPKMLPMLITSLQILQMFVGAIVSILTYIWRQDQGCHTTMEHLFWSFILYMTYFILFAHFFCQTYIRPKVKAKTKSQ

SEQ ID NO: 844745 - protein, 151 aa, Homo sapiens
MVTAMNVSHEVNQLFQPYNFELSKDMRPFFEEYWATSFPIALIYLVLIAVGQNYMKERKGFNLQGPLILWSFCLAIFSILGAVRMWGIMGTVLLTGGLKQTVCFINFIDNSTVKFWSWVFLLSKVIELAQCSCTQALDTRTKCLQEAGSSP

SEQ ID NO: 844746 - protein, 305 aa, Homo sapiens
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 844747 - protein, 305 aa, Homo sapiens; identical to SEQ ID NO: 844746

SEQ ID NO: 844748 - protein, 309 aa, Homo sapiens
MSSTQAPSGAAPCCSSWLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 844749 - protein, 185 aa, Homo sapiens
MWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 844750 - protein, 299 aa, Homo sapiens
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 844751 - protein, 283 aa, Homo sapiens
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 844752 - protein, 81 aa, Homo sapiens
ADWDLARGDFAQAAQQLWLALRALGRPCPPPNLDLACSLLWNLSPYTRPTETSNLEHLGHETPRAKSPEQLRGDPGLRGSL

SEQ ID NO: 844753 - protein, 248 aa, Homo sapiens
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKNLRDPKHFKSEKTGRAQLREGWRDSHQP

SEQ ID NO: 844754 - protein, 140 aa, Homo sapiens
RPSAGTPTVGSSGEWGRGRDPKAAAQLPTRPHVPCPCLPSIWHEWEIANNTFTGMWMRDGDACRSRSRQSKGASDGSPGRGAPVSPTHLPTFPPQVELACGKSNRLAHVSEPSTCVYALTFETPLVCHPHALLGRGAGRS

SEQ ID NO: 844755 - protein, 305 aa, Homo sapiens; identical to SEQ ID NO: 844746

SEQ ID NO: 844756 - protein, 305 aa, Homo sapiens; identical to SEQ ID NO: 844746

SEQ ID NO: 844757 - protein, 331 aa, Homo sapiens
MAAGLARLLLLLGLSAGGPAPAGAAKMKVVEEPNAFGEQPRGLAARAGDGPGPFPADLAASRRVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 844758 - protein, 349 aa, Homo sapiens
MAAGLARLLLLLGLSAGGPAPAGAAKMKVVEEPNAFGVNNPFLPQASRLQAKRDPSPVSETGFHRVSQDGLDLLTCDLPASASHSAGMTVMSHRAWPRLYYYYGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 844759 - protein, 150 aa, Homo sapiens
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKWPMCPSRAPASTR

SEQ ID NO: 844760 - protein, 149 aa, Homo sapiens
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKSWRRARATASKG

SEQ ID NO: 844761 - protein, 92 aa, Homo sapiens
WGSRRGECPGWSWLSRALCSTRRGCVCWAWLAANRDGRAVGRGREVLHPRGDSEAQPQQEHLADPAPQGVRFDQISGRASWWGRSFKGTSWR

SEQ ID NO: 844762 - protein, 70 aa, Homo sapiens
RERRPGPGLYLERFVFLKRFHPGGEEVLREQAGGDATENFEDVGHSTDAREMSCPKHSSLGSSIQMTDQS

SEQ ID NO: 844763 - protein, 92 aa, Homo sapiens; identical to SEQ ID NO: 844761

SEQ ID NO: 844764 - protein, 92 aa, Homo sapiens; identical to SEQ ID NO: 844761

SEQ ID NO: 844765 - protein, 138 aa, Homo sapiens
WGSRRGECPGWSWLSRALCSTRRGCVCWAWLAANRDGRAVGRGREVLHPRGDSEAQPQQEHLADPAPQGVRFDQISGRVSKTFIIGELHPDDRPKLNKPPETLITTIDSSSSWWTNWVIPAISAVAVALMYRLYMAED

SEQ ID NO: 844766 - protein, 92 aa, Homo sapiens; identical to SEQ ID NO: 844761

SEQ ID NO: 844767 - protein, 92 aa, Homo sapiens; identical to SEQ ID NO: 844761

SEQ ID NO: 844768 - protein, 143 aa, Homo sapiens
MAEQSDEAVKYYTLEEIQKHNHSKSTWLILHHKVYDLTKFLEEHPGGEEVLREQAGGDATENFEDVGHSTDAREMSCPKHSSLGSSIQMTDQSYTSLQNLTGGVPPALITTIDSSSSWWTNWVIPAISAVAVALMYRLYMAED

SEQ ID NO: 844769 - protein, 122 aa, Homo sapiens
MAEQSDEAVKYYTLEEIQKHNHSKSTWLILHHKVYDLTKFLEEHPGGEEVLREQAGGDATENFEDVGHSTDAREMSCPKHSSLGSSIQGQTKVKQASRNSSHYYVILFQLVDQLGDTAIPDR

SEQ ID NO: 844770 - protein, 92 aa, Homo sapiens; identical to SEQ ID NO: 844761

SEQ ID NO: 844771 - protein, 66 aa, Homo sapiens
FGEKIHLTIDLFQLVDQLGDPCHLCSGRRLDVSPIHGRGLNTSSEVSAGRACFGHGRKEAIANYFN

SEQ ID NO: 844772 - protein, 115 aa, Homo sapiens
MAEQSDEAVKYYTLEEIQKHNHSKSTWLILHHKVYDLTKFLEEHPGGEEVLREQAGGDATENFEDVGHSTDAREMSPPALITTIDSSSSWWTNWVIPAISAVAVALMYRLYMAED

SEQ ID NO: 844773 - protein, 92 aa, Homo sapiens; identical to SEQ ID NO: 844761

SEQ ID NO: 844774 - protein, 491 aa, Homo sapiens
QSSFATGFGDFRKLPALHCETLIPELNSSDSTASFGENIDIFLRKMDSDFSHAFQKELTCVICLNYLVDPVTICCGHSFCRPCLCLSWEEAQSPANCPACREPSPKMDFKTNILLKNLVTIARKASLWQFLSSEKQICGTHRQTKKMFCDMDKSLLCLLCSNSQEHGAHKHHPIEEAAEEHREKLLKQMRILWKKIQENQRNLYEEGRTAFLWRGNVVLRAQMIRNEYRKLHPVLHKEEKQHLERLNKEYQEIFQQLQRSWVKMDQKSKHLKEMYQELMEMCHKPDVELLQDLGDIVARSESVLLHMPQPVNPELTAGPITGLVYRLNRFRVEISFHFEVTNHNIRLFEDVRSWMFRRGPLNSDRSDYFAAWGARVFSFGKHYWELDVDNSCDWALGVCNNSWIRKNSTMVNSEDIFLLLCLKVDNHFNLLTTSPVFPHYIEKPLGRVGVFLDFESGSVSFLNVTKSSLIWSYPAGSLTFPVRPFFYTGHR

SEQ ID NO: 844775 - protein, 491 aa, Homo sapiens; identical to SEQ ID NO: 844774

SEQ ID NO: 844776 - protein, 2186 aa, Homo sapiens
AELTGIKWRRYNFGGHGDCGPIISAPAQDDPILLSFIRCLQANLLCVWRRDVKPDCKELWIFWWGDEPNLVGVIHHELQVVEEGLWENGLSYECRTLLFKAIHNLLERCLMDKNFVRIGKWFVRPYEKDEKPVNKSEHLSCAFTFFLHGESNVCTSVEIAQHQPIYLINEEHIHMAQSSPAPFQVLVSPYGLNGTLTGQAYKMSDPATRKLIEEWQYFYPMVLKKKEESKEEDELGYDDDFPVAVEVIVGGVRMVYPSAFVLISQNDIPVPQSVASAGGHIAVGQQGLGSVKDPSNCGMPLTPPTSPEQAILGESGGMQSAASHLVSQDGGMITMHSPKRSGKIPPKLHNHMVHRVWKECILNRTQSKRSQMSTPTLEEEPASNPATWDFVDPTQRVSCSCSRHKLLKRCAVGPNRPPTVSQPGFSAGPSSSSSLPPPASSKHKTAERQEKGDKLQKRPLIPFHHRPSVAEELCMEQDTPGQKLGLAGIDSSLEVSSSRKYDKQMAVPSRNTSKQMNLNPMDSPHSPISPLPPTLSPQPRGQETESLDPPSVPVNPALYGNGLELQQLSTLDDRTVLVGQRLPLMAEVSETALYCGIRPSNPESSEKWWHSYRLPPSDDAEFRPPELQGERCDAKMEVNSESTALQRLLAQPNKRFKIWQDKQPQLQPLHFLDPLPLSQQPGDSLGEVNDPYTFEDGDIKYIFTANKKCKQGTEKDSLKKNKSEDGFGTKDVTTPGHSTPVPDGKNAMSIFSSATKTDVRQDNAAGRAGSSSLTQVTDLAPSLHDLDNIFDNSDDDELGAVSPALRSSKMPAVGTEDRPLGKDGRAAVPYPPTVADLQRMFPTPPSLEQHPAFSPVMNYKDGISSETVTALGMMESPMVSMVSTQLTEFKMEVEDGLGSPKPEEIKDFSYVHKVPSFQPFVGSSMFAPLKMLPSHCLLPLKIPDACLFRPSWAIPPKIEQLPMPPAATFIRDGYNNVPSVGSLADPDYLNTPQMNTPVTLNSAAPASNSGAGVLPSPATPRFSVPTPRTPRTPRTPRGGGTASGQGSVKYDSTDQGSPASTPSTTRPLNSVEPATMQPIPEAHSLYVTLILSDSVMNIFKDRNFDSCCICACNMNIKGADVGLYIPDSSNEDQYRCTCGFSAIMNRKLGYNSGLFLEDELDIFGKNSDIGQAAERRLMMCQSTFLPQVEGTKKPQEPPISLLLLLQNQHTQPFASLNFLDYISSNNRQTLPCVSWSYDRVQADNNDYWTECFNALEQGRQYVDNPTGGKVDEALVRSATVHSWPHSNVLDISMLSSQDVVRMLLSLQPFLQDAIQKKRTGRTWENIQHVQGPLTWQQFHKMAGRGTYGSEESPEPLPIPTLLVGYDKDFLTISPFSLPFWERLLLDPYGGHRDVAYIVVCPENEALLEGAKTFFRDLSAVYEMCRLGQHKPICKVLRDGIMRVGKTVAQKLTDELVSEWFNQPWSGEENDNHSRLKLYAQVCRHHLAPYLATLQLDSSLLIPPKYQTPPAAAQGQATPGNAGPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQIVPCQYMLQTMKDEQVFYIQYLKSMAFSVYCQCRRPLPTQIHIKSLTGFGPAASIEMTLKNPERPSPIQLYSPPFILAPIKDKQTELGETFGEASQKYNVLFVGYCLSHDQRWLLASCTDLHGELLETCVVNIALPNRSRRSKVSARKIGLQKLWEWCIGIVQMTSLPWRVVIGRLGRLGHGELKDWSILLGECSLQTISKKLKDVCRMCGISAADSPSILSACLVAMEPQGSFVVMPDAVTMGSVFGRSTALNMQSSQLNTPQDASCTHILVFPTSSTIQVAPANYPNEDGFSPNNDDMFVDLPFPDDMDNDIGILMTGNLHSSPNSSPVPSPGSPSGIGVGSHFQHSRSQGERLLSREAPEELKQQPLALGYFVSTAKAENLPQWFWSSCPQAQNQCPLFLKASLHHHISVAQTDELLPARNSQRVPHPLDSKTTSDVLRFVLEQYNALSWLTCNPATQDRTSCLPVHFVVLTQLYNAIMNIL

SEQ ID NO: 844777 - protein, 2442 aa, Homo sapiens
AELTGIKWRRYNFGGHGDCGPIISAPAQDDPILLSFIRCLQANLLCVWRRDVKPDCKELWIFWWGDEPNLVGVIHHELQVVEEGLWENGLSYECRTLLFKAIHNLLERCLMDKNFVRIGKWFVRPYEKDEKPVNKSEHLSCAFTFFLHGESNVCTSVEIAQHQPIYLINEEHIHMAQSSPAPFQVLVSPYGLNGTLTGQAYKMSDPATRKLIEEWQYFYPMVLKKKEESKEEDELGYDDDFPVAVEVIVGGVRMVYPSAFVLISQNDIPVPQSVASAGGHIAVGQQGLGSVKDPSNCGMPLTPPTSPEQAILGESGGMQSAASHLVSQDGGMITMHSPKRSGKIPPKLHNHMVHRVWKECILNRTQSKRSQMSTPTLEEEPASNPATWDFVDPTQRVSCSCSRHKLLKRCAVGPNRPPTVSQPGFSAGPSSSSSLPPPASSKHKTAERQEKGDKLQKRPLIPFHHRPSVAEELCMEQDTPGQKLGLAGIDSSLEVSSSRKYDKQMAVPSRNTSKQMNLNPMDSPHSPISPLPPTLSPQPRGQETESLDPPSVPVNPALYGNGLELQQLSTLDDRTVLVGQRLPLMAEVSETALYCGIRPSNPESSEKWWHSYRLPPSDDAEFRPPELQGERCDAKMEVNSESTALQRLRQLSAPPTRPPEGHGLPPHLYLLNFRFKIEVGFFFVLLDSRIWKMFNGQMLCPTYRLAHMSFDTWAYKELFMPFKYTPNILIHFVPYCLLIKEYSFIRLSILLSVPSLYVDIFEEGFACIQVYVSCIYYNIYSSFEPPILKLYIDDLIYIFTVPYYYVNFITEKLEAMQLVNDTEEFETRQSVLRTCALEVELMDPETKTYILTKYANFYLIMNINCKSKHYIGEFLVVFTKSLNFVNALRHEMLFFFFFFLYFRLLAQPNKRFKIWQDKQPQLQPLHFLDPLPLSQQPGDSLGEVNDPYTFEDGDIKYIFTANKKCKQGTEKDSLKKNKSEDGFGTKDVTTPGHSTPVPDGKNAMSIFSSATKTDVRQDNAAGRAGSSSLTQVTDLAPSLHDLDNIFDNSDDDELGAVSPALRSSKMPAVGTEDRPLGKDGRAAVPYPPTVADLQRMFPTPPSLEQHPAFSPVMNYKDGISSETVTALGMMESPMVSMVSTQLTEFKMEVEDGLGSPKPEEIKDFSYVHKVPSFQPFVGSSMFAPLKMLPSHCLLPLKIPDACLFRPSWAIPPKIEQLPMPPAATFIRDGYNNVPSVGSLADPDYLNTPQMNTPVTLNSAAPASNSGAGVLPSPATPRFSVPTPRTPRTPRTPRGGGTASGQGSVKYDSTDQGSPASTPSTTRPLNSVEPATMQPIPEAHSLYVTLILSDSVMNIFKDRNFDSCCICACNMNIKGADVGLYIPDSSNEDQYRCTCGFSAIMNRKLGYNSGLFLEDELDIFGKNSDIGQAAERRLMMCQSTFLPQVEGTKKPQEPPISLLLLLQNQHTQPFASLNFLDYISSNNRQTLPCVSWSYDRVQADNNDYWTECFNALEQGRQYVDNPTGGKVDEALVRSATVHSWPHSNVLDISMLSSQDVVRMLLSLQPFLQDAIQKKRTGRTWENIQHVQGPLTWQQFHKMAGRGTYGSEESPEPLPIPTLLVGYDKDFLTISPFSLPFWERLLLDPYGGHRDVAYIVVCPENEALLEGAKTFFRDLSAVYEMCRLGQHKPICKVLRDGIMRVGKTVAQKLTDELVSEWFNQPWSGEENDNHSRLKLYAQVCRHHLAPYLATLQLDSSLLIPPKYQTPPAAAQGQATPGNAGPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQIVPCQYMLQTMKDEQVFYIQYLKSMAFSVYCQCRRPLPTQIHIKSLTGFGPAASIEMTLKNPERPSPIQLYSPPFILAPIKDKQTELGETFGEASQKYNVLFVGYCLSHDQRWLLASCTDLHGELLETCVVNIALPNRSRRSKVSARKIGLQKLWEWCIGIVQMTSLPWRVVIGRLGRLGHGELKDWSILLGECSLQTISKKLKDVCRMCGISAADSPSILSACLVAMEPQGSFVVMPDAVTMGSVFGRSTALNMQSSQLNTPQDASCTHILVFPTSSTIQVAPANYPNEDGFSPNNDDMFVDLPFPDDMDNDIGILMTGNLHSSPNSSPVPSPGSPSGIGVGSHFQHSRSQGERLLSREAPEELKQQPLALGYFVSTAKAENLPQWFWSSCPQAQNQCPLFLKASLHHHISVAQTDELLPARNSQRVPHPLDSKTTSDVLRFVLEQYNALSWLTCNPATQDRTSCLPVHFVVLTQLYNAIMNIL

SEQ ID NO: 844778 - protein, 792 aa, Homo sapiens
MAIVEEMESGKSVKQKVVCDDSRSLTNSGLFLEDELDIFGKNSDIGQAAERRLMMCQSTFLPQVEGTKKPQEPPISNHSRLKLYAQVCRHHLAPYLATLQLDSSLLIPPKYQTPPAAAQGQATPGNAGPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQIVPCQYMLQTMKDEQVFYIQYLKSMAFSVYCQCRRPLPTQIHIKSLTGFGPAASIEMTLKNPERPSPIQLYSPPFILAPIKDKQTELGETFGEASQKYNVLFVGYCLSHDQRWLLASCTDLHGELLETCVVNIALPNRSRRSKVSARKIGLQKLWEWCIGIVQMTSLPWRVVIGRLGRLGHGELKDWSILLGECSLQTISKKLKDVCRMCGISAADSPSILSACLVAMEPQGSFVVMPDAVTMGSVFGRSTALNMQSSQLNTPQDASCTHILVFPTSSTIQVAPANYPNEDGFSPNNDDMFVDLPFPDDMDNDIGILMTGNLHSSPNSSPVPSPGSPSGIGVGSHFQHSRSQGERLLSREAPEELKQQPLALGYFVSTAKAENLPQWFWSSCPQAQNQCPLFLKASLHHHISVAQTDELLPARNSQRVPHPLDSKTTSDVLRFVLEQYNALSWLTCNPATQDRTSCLPVHFVVLTQLYNAIMNIL

SEQ ID NO: 844779 - protein, 602 aa, Homo sapiens [sequence omitted]

SEQ ID NO: 844780 - protein, 2454 aa, Homo sapiens
AELTGIKWRRYNFGGHGDCGPIISAPAQDDPILLSFIRCLQANLLCVWRRDVKPDCKELWIFWWGDEPNLVGVIHHELQVVEEGLWENGLSYECRTLLFKAIHNLLERCLMDKNFVRIGKWFVRPYEKDEKPVNKSEHLSCAFTFFLHGESNVCTSVEIAQHQPIYLINEEHIHMAQSSPAPFQVLVSPYGLNGTLTGQAYKMSDPATRKLIEEWQYFYPMVLKKKEESKEEDELGYDDDFPVAVEVIVGGVRMVYPSAFVLISQNDIPVPQSVASAGGHIAVGQQGLGSVKDPSNCGMPLTPPTSPEQAILGESGGMQSAASHLVSQDGGMITMHSPKRSGKIPPKLHNHMVHRVWKECILNRTQSKRSQMSTPTLEEEPASNPATWDFVDPTQRVSCSCSRHKLLKRCAVGPNRPPTVSQPGFSAGPSSSSSLPPPASSKHKTAERQEKGDKLQKRPLIPFHHRPSVAEELCMEQDTPGQKLGLAGIDSSLEVSSSRKYDKQMAVPSRNTSKQMNLNPMDSPHSPISPLPPTLSPQPRGQETESLDPPSVPVNPALYGNGLELQQLSTLDDRTVLVGQRLPLMAEVSETALYCGIRPSNPESSEKWWHSYRLPPSDDAEFRPPELQGERCDAKMEVNSESTALQRLRQLSAPPTRPPEGHGLPPHLYLLNFRFKIEVGFFFVLLDSRIWKMFNGQMLCPTYRLAHMSFDTWAYKELFMPFKYTPNILIHFVPYCLLIKEYSFIRLSILLSVPSLYVDIFEEGFACIQVYVSCIYYNIYSSFEPPILKLYIDDLIYIFTVPYYYVNFITEKLEAMQLVNDTEEFETRQSVLRTCALEVELMDPETKTYILTKYANFYLIMNINCKSKHYIGEFLVVFTKSLNFVNALRHEMLFFFFFFLYFRLLAQPNKRFKIWQDKQPQLQPLHFLDPLPLSQQPGDSLGEVNDPYTFEDGDIKYIFTANKKCKQGTEKDSLKKNKSEDGFGTKDVTTPGHSTPVPDGKNAMSIFSSATKTDVRQDNAAGRAGSSSLTQVTDLAPSLHDLDNIFDNSDDDELGAVSPALRSSKMPAVGTEDRPLGKDGRAAVPYPPTVADLQRMFPTPPSLEQHPAFSPVMNYKDGISSETVTALGMMESPMVSMVSTQLTEFKMEVEDGLGSPKPEEIKDFSYVHKVPSFQPFVGSSMFAPLKMLPSHCLLPLKIPDACLFRPSWAIPPKIEQLPMPPAATFIRDGYNNVPSVGSLADPDYLNTPQMNTPVTLNSAAPASNSGAGVLPSPATPRFSVPTPRTPRTPRTPRGGGTASGQGSVKYDSTDQGSPASTPSTTRPLNSVEPATMQPIPEAHSLYVTLILSDSVMNIFKDRNFDSCCICACNMNIKGADVGLYIPDSSNEDQYRCTCGFSAIMNRKLGYNSGLFLEDELDIFGKNSDIGQAAERRLMMCQSTFLPQVEGTKKPQEPPISLLLLLQNQHTQPFASLNFLDYISSNNRQTLPCVSWSYDRVQADNNDYWTECFNALEQGRQYVDNPTGGKVDEALVRSATVHSWPHSNVLDISMLSSQDVVRMLLSLQPFLQDAIQKKRTGRTWENIQHVQGPLTWQQFHKMAGRGTYGSEESPEPLPIPTLLVGYDKDFLTISPFSLPFWERLLLDPYGGHRDVAYIVVCPENEALLEGAKTFFRDLSAVYEMCRLGQHKPICKVLRDGIMRVGKTVAQKLTDELVSEWFNQPWSGEENDNHSRLKLYAQVCRHHLAPYLATLQLDSSLLIPPKYQTPPAAAQGQATPGNAGPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQIVPCQYMLQTMKDEQVFYIQYLKSMAFSVYCQCRRPLPTQIHIKSLTGFGPAASIEMTLKNPERPSPIQLYSPPFILAPIKDKQTELGETFGEASQKYNVLFVGYCLSHDQRWLLASCTDLHGELLETCVVNIALPNRDPFPFPISLFVRSRRSKVSARKIGLQKLWEWCIGIVQMTSLPWRVVIGRLGRLGHGELKDWSILLGECSLQTISKKLKDVCRMCGISAADSPSILSACLVAMEPQGSFVVMPDAVTMGSVFGRSTALNMQSSQLNTPQDASCTHILVFPTSSTIQVAPANYPNEDGFSPNNDDMFVDLPFPDDMDNDIGILMTGNLHSSPNSSPVPSPGSPSGIGVGSHFQHSRSQGERLLSREAPEELKQQPLALGYFVSTAKAENLPQWFWSSCPQAQNQCPLFLKASLHHHISVAQTDELLPARNSQRVPHPLDSKTTSDVLRFVLEQYNALSWLTCNPATQDRTSCLPVHFVVLTQLYNAIMNIL

SEQ ID NO: 844781 - protein, 2442 aa, Homo sapiens; identical to SEQ ID NO: 844777

SEQ ID NO: 844782 - protein, 2291 aa, Homo sapiens
AELTGIKWRRYNFGGHGDCGPIISAPAQDDPILLSFIRCLQANLLCVWRRDVKPDCKELWIFWWGDEPNLVGVIHHELQVVEEGLWENGLSYECRTLLFKAIHNLLERCLMDKNFVRIGKWFVRPYEKDEKPVNKSEHLSCAFTFFLHGESNVCTSVEIAQHQPIYLINEEHIHMAQSSPAPFQVLVSPYGLNGTLTGQAYKMSDPATRKLIEEWQYFYPMVLKKKEESKEEDELGYDDDFPVAVEVIVGGVRMVYPSAFVLISQNDIPVPQSVASAGGHIAVGQQGLGSVKDPSNCGMPLTPPTSPEQAILGESGGMQSAASHLVSQDGGMITMHSPKRSGKIPPKLHNHMVHRVWKECILNRTQSKRSQMSTPTLEEEPASNPATWDFVDPTQRVSCSCSRHKLLKRCAVGPNRPPTVSQPGFSAGPSSSSSLPPPASSKHKTAERQEKGDKLQKRPLIPFHHRPSVAEELCMEQDTPGQKLGLAGIDSSLEVSSSRKYDKQMAVPSRNTSKQMNLNPMDSPHSPISPLPPTLSPQPRGQETESLDPPSVPVNPALYGNGLELQQLSTLDDRTVLVGQRLPLMAEVSETALYCGIRPSNPESSEKWWHSYRLPPSDDAEFRPPELQGERCDAKMEVNSESTALQRLRQLSAPPTRPPEGHGLPPHLYLLNFRFKIEVGFFFVLLDSRIWKMFNGQMLCPTYRLAHMSFDTWAYKELFMPFKYTPNILIHFVPYCLLIKEYSFIRLSILLSVPSLYVDIFEEGFACIQVYVSCIYYNIYSSFEPPILKLYIDDLIYIFTVPYYYVNFITEKLEAMQLVNDTEEFETRQSVLRTCALEVELMDPETKTYILTKYANFYLIMNINCKSKHYIGEFLVVFTKSLNFVNALRHEMLFFFFFFLYFRLLAQPNKRFKIWQDKQPQLQPLHFLDPLPLSQQPGDSLGEVNDPYTFEDGDIKYIFTANKKCKQGTEKDSLKKNKSEDGFGTKDVTTPGHSTPVPDGKNAMSIFSSATKTDVRQDNAAGRAGSSSLTQVTDLAPSLHDLDNIFDNSDDDELGAVSPALRSSKMPAVGTEDRPLGKDGRAAVPYPPTVADLQRMFPTPPSLEQHPAFSPVMNYKDGISSETVTALGMMESPMVSMVSTQLTEFKMEVEDGLGSPKPEEIKDFSYVHKVPSFQPFVGSSMFAPLKMLPSHCLLPLKIPDACLFRPSWAIPPKIEQLPMPPAATFIRDGYNNVPSVGSLADPDYLNTPQMNTPVTLNSAAPASNSGAGVLPSPATPRFSVPTPRTPRTPRTPRGGGTASGQGSVKYDSTDQGSPASTPSTTRPLNSVEPATMQPIPEAHSLYVTLILSDSVMNIFKDRNFDSCCICACNMNIKGADVGLYIPDSSNEDQYRCTCGFSAIMNRKLGYNSGLFLEDELDIFGKNSDIGQAAERRLMMCQSTFLPQVEGTKKPQEPPISLLLLLQNQHTQPFASLNFLDYISSNNRQTLPCVSWSYDRVQADNNDYWTECFNALEQGRQYVDNPTGGKVDEALVRSATVHSWPHSNVLDISMLSSQDVVRMLLSLQPFLQDAIQKKRTGRTWENIQHVQGPLTWQQFHKMAGRGTYGSEESPEPLPIPTLLVGYDKDFLTISPFSLPFWERLLLDPYGGHRDVAYIVVCPENEALLEGAKTFFRDLSAVYEMCRLGQHKPICKVLRDGIMRVGKTVAQKLTDELVSEWFNQPWSGEENDNHSRLKLYAQVCRHHLAPYLATLQLDSSLLIPPKYQTPPAAAQGQATPGNAGPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQIVPCQYMLQTMKDEQVFYIQYLKSMAFSVYCQCRRPLPTQIHIKSLTGFGPAASIEMTLKNPERPSPIQLYSPPFILAPIKDKQTELGETFGEASQKYNVLFVGYCLSHDQRWLLASCTDLHGELLETCVVNIALPNRSRRSKVSARKIGLQKLWEWCIGIVQMTSLPWRVVIGRLGRLGHGELKDWSILLGECSLQTISKKLKDVCRMCGISAADSPSILSACLVAMEPQGSFVVMPDAVTMGSVFGRSTALNMQSSQLNTPQDASCTHILVFPTSSTIQVAPANYPNEDGFSPNNDDMFVDLPFPDDMDNDIGILMTGNLHSSPRDTGDTLE

SEQ ID NO: 844783 - protein, 1137 aa, Homo sapiens
MLFFFFFFLYFRLLAQPNKRFKIWQDKQPQLQPLHFLDPLPLSQQPGDSLGEVNDPYTFEDGDIKYIFTANKKCKQGTEKDSLKKNKSEDGFGTKDVTTPGHSTPVPDGKNAMSIFSSATKTDVRQDNAAGRAGSSSLTQVTDLAPSLHDLDNIFDNSDDDELGAVSPALRSSKMPAVGTEDRPLGKDGRAAVPYPPTVADLQRMFPTPPSLEQHPAFSPVMNYKDGISSETVTALGMMESPMVSMVSTQLTEFKMEVEDGLGSPKPEEIKDFSYVHKVPSFQPFVGSSMFAPLKMLPSHCLLPLKIPDACLFRPSWAIPPKIEQLPMPPAATFIRDGYNNVPSVGSLADPDYLNTPQMNTPVTLNSAAPASNSGAGVLPSPATPRFSVPTPRTPRTPRTPRGGGTASGQGSVKYDSTDQGSPASTPSTTRPLNSVEPATMQPIPEAHSLYVTLILSDSVMNIFKDRNFDSCCICACNMNIKGADVGLYIPDSSNEDQYRCTCGFSAIMNRKLGYNSGLFLEDELDIFGKNSDIGQAAERRLMMCQSTFLPQVEGTKKPQEPPISLLLLLQNQHTQPFASLNFLDYISSNNRQTLPCVSWSYDRVQADNNDYWTECFNALEQGRQYVDNPTGGKVDEALVRSATVHSWPHSNVLDISMLSSQDVVRMLLSLQPFLQDAIQKKRTGRTWENIQHVQGPLTWQQFHKMAGRGTYGSEESPEPLPIPTLLVGYDKDFLTISPFSLPFWERLLLDPYGGHRDVAYIVVCPENEALLEGAKTFFRDLSAVYEMCRLGQHKPICKVLRDGIMRVGKTVAQKLTDELVSEWFNQPWSGEENDNHSRLKLYAQVCRHHLAPYLATLQLDSSLLIPPKYQTPPAAAQGQATPGNAGPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQIVPCQYMLQTMKDEQVFYIQYLKSMAFSVYCQCRRPLPTQIHIKSLTGFGPAASIEMTLKNPEVGIGRTET

SEQ ID NO: 844784 - protein, 1204 aa, Homo sapiens
MLFFFFFFLYFRLLAQPNKRFKIWQDKQPQLQPLHFLDPLPLSQQPGDSLGEVNDPYTFEDGDIKYIFTANKKCKQGTEKDSLKKNKSEDGFGTKDVTTPGHSTPVPDGKNAMSIFSSATKTDVRQDNAAGRAGSSSLTQVTDLAPSLHDLDNIFDNSDDDELGAVSPALRSSKMPAVGTEDRPLGKDGRAAVPYPPTVADLQRMFPTPPSLEQHPAFSPVMNYKDGISSETVTALGMMESPMVSMVSTQLTEFKMEVEDGLGSPKPEEIKDFSYVHKVPSFQPFVGSSMFAPLKMLPSHCLLPLKIPDACLFRPSWAIPPKIEQLPMPPAATFIRDGYNNVPSVGSLADPDYLNTPQMNTPVTLNSAAPASNSGAGVLPSPATPRFSVPTPRTPRTPRTPRGGGTASGQGSVKYDSTDQGSPASTPSTTRPLNSVEPATMQPIPEAHSLYVTLILSDSVMNIFKDRNFDSCCICACNMNIKGADVGLYIPDSSNEDQYRCTCGFSAIMNRKLGYNSGLFLEDELDIFGKNSDIGQAAERRLMMCQSTFLPQVEGTKKPQEPPISLLLLLQNQHTQPFASLNFLDYISSNNRQTLPCVSWSYDRVQADNNDYWTECFNALEQGRQYVDNPTGGKVDEALVRSATVHSWPHSNVLDISMLSSQDVVRMLLSLQPFLQDAIQKKRTGRTWENIQHVQGPLTWQQFHKMAGRGTYGSEESPEPLPIPTLLVGYDKDFLTISPFSLPFWERLLLDPYGGHRDVAYIVVCPENEALLEGAKTFFRDLSAVYEMCRLGQHKPICKVLRDGIMRVGKTVAQKLTDELVSEWFNQPWSGEENDNHSRLKLYAQVCRHHLAPYLATLQLDSSLLIPPKYQTPPAAAQGQATPGNAGPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQIVPCQYMLQTMKDEQVFYIQYLKSMAFSVYCQCRRPLPTQIHIKSLTGFGPAASIEMTLKNPERPSPIQLYSPPFILAPIKDKQTELGETFGEASQKYNVLFVGYCLSHDQRWLLASCTDLHGELLETCVVNIALPNR

SEQ ID NO: 844785 - protein, 647 aa, Homo sapiens
AELTGIKWRRYNFGGHGDCGPIISAPAQDDPILLSFIRCLQANLLCVWRRDVKPDCKELWIFWWGDEPNLVGVIHHELQVVEEGLWENGLSYECRTLLFKAIHNLLERCLMDKNFVRIGKWFVRPYEKDEKPVNKSEHLSCAFTFFLHGESNVCTSVEIAQHQPIYLINEEHIHMAQSSPAPFQVLVSPYGLNGTLTGQAYKMSDPATRKLIEEWQYFYPMVLKKKEESKEEDELGYDDDFPVAVEVIVGGVRMVYPSAFVLISQNDIPVPQSVASAGGHIAVGQQGLGSVKDPSNCGMPLTPPTSPEQAILGESGGMQSAASHLVSQDGGMITMHSPKRSGKIPPKLHNHMVHRVWKECILNRTQSKRSQMSTPTLEEEPASNPATWDFVDPTQRVSCSCSRHKLLKRCAVGPNRPPTVSQPGFSAGPSSSSSLPPPASSKHKTAERQEKGDKLQKRPLIPFHHRPSVAEELCMEQDTPGQKLGLAGIDSSLEVSSSRKYDKQMAVPSRNTSKQMNLNPMDSPHSPISPLPPTLSPQPRGQETESLDPPSVPVNPALYGNGLELQQLSTLDDRTVLVGQRLPLMAEVSETALYCGIRPSNPESSEKWWHSYRLPPSDDAEFRPPELQGERCDAKMEVNSESTALQR

SEQ ID NO: 844786 - protein, 2442 aa, Homo sapiens; identical to SEQ ID NO: 844777

SEQ ID NO: 844787 - protein, 479 aa, Homo sapiens [sequence omitted]

SEQ ID NO: 844788 - protein, 2442 aa, Homo sapiens; identical to SEQ ID NO: 844777

SEQ ID NO: 844789 - protein, 1076 aa, Homo sapiens
MLFFFFFFLYFRLLAQPNKRFKIWQDKQPQLQPLHFLDPLPLSQQPGDSLGEVNDPYTFEDGDIKYIFTANKKCKQGTEKDSLKKNKSEDGFGTKDVTTPGHSTPVPDGKNAMSIFSSATKTDVRQDNAAGRAGSSSLTQVTDLAPSLHDLDNIFDNSDDDELGAVSPALRSSKMPAVGTEDRPLGKDGRAAVPYPPTVADLQRMFPTPPSLEQHPAFSPVMNYKDGISSETVTALGMMESPMVSMVSTQLTEFKMEVEDGLGSPKPEEIKDFSYVHKVPSFQPFVGSSMFAPLKMLPSHCLLPLKIPDACLFRPSWAIPPKIEQLPMPPAATFIRDGYNNVPSVGSLADPDYLNTPQMNTPVTLNSAAPASNSGAGVLPSPATPRFSVPTPRTPRTPRTPRGGGTASGQGSVKYDSTDQGSPASTPSTTRPLNSVEPATMQPIPEAHSLYVTLILSDSVMNIFKDRNFDSCCICACNMNIKGADVGLYIPDSSNEDQYRCTCGFSAIMNRKLGYNSGLFLEDELDIFGKNSDIGQAAERRLMMCQSTFLPQVEGTKKPQEPPISLLLLLQNQHTQPFASLNFLDYISSNNRQTLPCVSWSYDRVQADNNDYWTECFNALEQGRQYVDNPTGGKVDEALVRSATVHSWPHSNVLDISMLSSQDVVRMLLSLQPFLQDAIQKKRTGRTWENIQHVQGPLTWQQFHKMAGRGTYGSEESPEPLPIPTLLVGYDKDFLTISPFSLPFWERLLLDPYGGHRDVAYIVVCPENEALLEGAKTFFRDLSAVYEMCRLGQHKPICKVLRDGIMRVGKTVAQKLTDELVSEWFNQPWSGEENDNHSRLKLYAQVCRHHLAPYLATLQLDSSLLIPPKYQTPPAAAQGQATPGNAGPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQVTVCKFIIYF

SEQ ID NO: 844790 - protein, 647 aa, Homo sapiens; identical to SEQ ID NO: 844785

SEQ ID NO: 844791 - protein, 339 aa, Homo sapiens
AELTGIKWRRYNFGGHGDCGPIISAPAQDDPILLSFIRCLQANLLCVWRRDVKPDCKELWIFWWGDEPNLVGVIHHELQVVEEGLWENGLSYECRTLLFKAIHNLLERCLMDKNFVRIGKWFVRPYEKDEKPVNKSEHLSCAFTFFLHGESNVCTSVEIAQHQPIYLINEEHIHMAQSSPAPFQVLVSPYGLNGTLTGQAYKMSDPATRKLIEEWQYFYPMVLKKKEESKEEDELGYDDDFPVAVEVIVGGVRMVYPSAFVLISQNDIPVPQSVASAGGHIAVGQQGLGSVKDPSNCGMPLTPPTSPEQAILGESGGMQSAVSVLPPTSPPSLHLQFLP

SEQ ID NO: 844792 - protein, 123 aa, Homo sapiens [sequence omitted]

SEQ ID NO: 844793 - protein, 123 aa, Homo sapiens [sequence omitted]

SEQ ID NO: 844794 - protein, 137 aa, Homo sapiens
AEGDCHMIAKKWHINEAPLQGSFLLLSPLKTIRWFEGGHGGSHLAQRRRGAHSSALRSPNTSLPPSAPGLRSRARPPAGRSRSVADRAARDAAGLTSRAEVRAESNRTRTLRAECASSARRERSGAQRRPPGCGRAT

SEQ ID NO: 844795 - protein, 137 aa, Homo sapiens; identical to SEQ ID NO: 844794

SEQ ID NO: 844796 - protein, 117 aa, Homo sapiens
GLGRQPQAPSSAAPEALAVAAPGVRSEPRLLVVPAPRPPLSGGSVKPGGEGGGGGPAGGELAANMFPMVAGGGTCSRPGLRSHPVRHAQPNSLPPPPPPSPAWCIFWTCPFWKKLLC

SEQ ID NO: 844797 - protein, 83 aa, Homo sapiens
PPAWLPPCSLISDCCASNQRDSVGVGPSEPAPVSPVKHDSNSNSANFQDVEDMPDRCALEESESPGEPRHHSWIAKVCPCKVS

SEQ ID NO: 844798 - protein, 71 aa, Homo sapiens
CRNHPSSASLTLGAVDRSSPVSPVKHDSNSNSANFQDVEDMPDRCALEESESPGEPRHHSWIAKVCPCKVS

SEQ ID NO: 844799 - protein, 130 aa, Homo sapiens
DDLSRVTLPARHATLPQCSSRAALIPVDCGRDGEGEASPGGRQWPGRLSGCCCMAARWRYRTGCCIPERARRGSASSWTASEASAPTSPTTDAGASRSRVRPHRGHAGSLQLQRHRPGLAAAAFCQLVVV

SEQ ID NO: 844800 - protein, 199 aa, Homo sapiens
DDLSRVTLPARHATLPQCSSRAALIPVDCGRDGEGEASPGGRQWPGRLSGCCCMAARWRYRTGCCIPERARRGSASSWTASEASAPTSPTTDAGASRSRGTGDRCRRRGLGAGPGVARKPGGGNGSGPTVDMPVPSSFNDIGQGWRLRHFVSWLWYEREVTLLERWIQDLCTRVVLRIGSAHFYAIVVSQGLLCPEHRL

SEQ ID NO: 844801 - protein, 133 aa, Homo sapiens
DDLSRVTLPARHATLPQCSSRAALIPVDCGRDGEGEASPGGRQWPGRLSGCCCMAARWRYRTGCCIPERARRGSASSWTASEASAPTSPTTDAGASRSRGTGDRCRRRGLGAGPGVARKPGGGNGDWMEDLKT

SEQ ID NO: 844802 - protein, 185 aa, Homo sapiens
DDLSRVTLPARHATLPQCSSRAALIPETAAETGRGKPRLGGGSGLGGSPAAVVWLHVGATGRDAVSPREPVVAAQAAGRPLKLPRRLLRQPTPGLRGAESGPTVDMPVPSSFNDIGQGWRLRHFVSWLWYEREVTLLERWIQDLCTRVVLRIGSAHFYAIVDCCGLCFYTRHPPPTSMTSPSPPA

SEQ ID NO: 844803 - protein, 68 aa, Homo sapiens
RLVLALALVRPRAVGWAPVRAPIYVSSWAVQVSQGNREVERLARKFGFVNLGPVGGTGIDGKWGLGGD

SEQ ID NO: 844804 - protein, 282 aa, Homo sapiens
RLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRHGTRCAGEVAAMANNGFCGVGVAFNARIGGVRMLDGTITDVIEAQSLSLQPQHIHIYSASWGPEDDGRTVDGPGILTREAFRRGVTKVSGSPRR

SEQ ID NO: 844805 - protein, 316 aa, Homo sapiens
RLVLALALVRPRAVGWAPVRAPIYVSSWAVQVSQGNREVERLARKFGFVNLGPIFPDGQYFHLRHRGVVQQSLTPHWGHRLHLKKNPKLCAFCGSDPPGPQVYTARGGRKTQIRKSWRLPGLVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRHGTRCAGEVAAMANNGFCGVGVAFNARIGGVRMLDGTITDVIEAQSLSLQPQHIHIYSASWGPEDDGRTVDGPGILTREAFRRGVTKVSGSPRR

SEQ ID NO: 844806 - protein, 130 aa, Homo sapiens
ECLTRPPAFGFPAAHPRLAPSGSSSGLTQPPQASALRGLRMHPVSTISLLPGKSVYSALLCLYLFSLHVPPETIILFNHHLSVDNLKLCLQPRAPSAAPAHLPPNSLRDLSKIPSEGHSFSLYFLVVTVP

SEQ ID NO: 844807 - protein, 130 aa, Homo sapiens
MWRGTTDVGGSLAPRYSIKQRGHRPHTYISYHPLRFHGVFALLPAFGKHIIDEDVSKTIMFLVVDSTARRCNYSIRKLASTSQTIVSYITLQTCDRIITTRTLLFIETQQYNNSTIIHYLYSIATTTSTH

SEQ ID NO: 844808 - protein, 121 aa, Homo sapiens
WAPGSRKCCPALRKRFIGPRAPSPSFSVRDVELSDPARERGEMPVAVGPYGQSQPSCFDRVKMGFVMGCAVGMAAGALFGTFSCLRIGMRGRELMGGIGKTMMQSGGTFGTFMAIGMGIRC

SEQ ID NO: 844809 - protein, 98 aa, Homo sapiens
SLPKVAKVELSDPARERGEMPVAVGPYGQSQPSCFDRVKMGFVMGCAVGMAAGALFGTFSCLRIGMRGRELMGGIGKTMMQSGGTFGTFMAIGMGIRC

SEQ ID NO: 844810 - protein, 101 aa, Homo sapiens
SELAEVSVRDVELSDPARERGEMPVAVGPYGQSQPSCFDRVKMGFVMGCAVGMAAGALFGTFSCLRIGMRGRELMGGIGKTMMQSGGTFGTFMAIGMGIRC

SEQ ID NO: 844811 - protein, 121 aa, Homo sapiens; identical to SEQ ID NO: 844808

SEQ ID NO: 844812 - protein, 180 aa, Homo sapiens
WAPGSRKCCPALRKRFIGPRAPSPSFSVRDVELSDPARERGEARRRATRGRNAKRVVESGYPLIFLPLLPLSPWAHFPAYRFRPRPTLGPAPGPTLSYPPQMPVAVGPYGQSQPSCFDRVKMGFVMGCAVGMAAGALFGTFSCLRIGMRGRELMGGIGKTMMQSGGTFGTFMAIGMGIRC

SEQ ID NO: 844813 - protein, 101 aa, Homo sapiens; identical to SEQ ID NO: 844810

SEQ ID NO: 844814 - protein, 121 aa, Homo sapiens; identical to SEQ ID NO: 844808

SEQ ID NO: 844815 - protein, 121 aa, Homo sapiens; identical to SEQ ID NO: 844808

SEQ ID NO: 844816 - protein, 121 aa, Homo sapiens; identical to SEQ ID NO: 844808

SEQ ID NO: 844817 - protein, 101 aa, Homo sapiens; identical to SEQ ID NO: 844810

SEQ ID NO: 844818 - protein, 121 aa, Homo sapiens; identical to SEQ ID NO: 844808

SEQ ID NO: 844819 - protein, 98 aa, Homo sapiens
NKSGDAVREEKRSTNLAANTPGKGGRLRFASPSGPQVSAAPLCPDDPVTFTRPGCIAALGSHLLWQHLSCCSTLACLECLPHTSQPSRNWLNGGSLSK

SEQ ID NO: 844820 - protein, 110 aa, Homo sapiens [sequence omitted]

SEQ ID NO: 844821 - protein, 219 aa, Homo sapiens
MSETAPAAPAAPAPAEKTPVKKKARKSAGAAKRKASGPPVSELITKAVAASKERSGVSLAALKKALAAAGYDVEKNNSRIKLGLKSLVSKGTLVQTKGTGASGSFKLNKKAASGEAKPKAKKAGAAKAKKPAGAAKKPKKATGAATPKKSAKKTPKKAKKPAAAAGAKKAKSPKKAKAAKPKKAPKSPAKAKAVKPKAAKPKTAKPKAAKPKKAAAKKK

SEQ ID NO: 844822 - protein, 61 aa, Homo sapiens
MSETAPAAPAAPAPAEKTPVKKKARKSAGAAKPQGSQAKEGGSQEKVESSFGQLLRSPTQP

SEQ ID NO: 844823 - protein, 84 aa, Homo sapiens
SFSSPRTLHIDPTLATSTSWTVTTFRGEHNVLQHAFLKVQLATGQHLNSSSAKLFSEYLRYQHDPGTAPASAVLSNSSSLGPLL

SEQ ID NO: 844824 - protein, 668 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGVVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 844825 - protein, 668 aa, Homo sapiens; identical to SEQ ID NO: 844824

SEQ ID NO: 844826 - protein, 668 aa, Homo sapiens; identical to SEQ ID NO: 844824

SEQ ID NO: 844827 - protein, 592 aa, Homo sapiens [sequence omitted]

SEQ ID NO: 844828 - protein, 146 aa, Homo sapiens
DSWTVQRRWTAQRRLDSTEAVDSTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGSPSPQPDSTDNDDYDDISAA

SEQ ID NO: 844829 - protein, 39 aa, Homo sapiens
MLPIQVQAPPPEDSDSGSDSDYEHYDFSAQPPVALTTFY

SEQ ID NO: 844830 - protein, 626 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGVVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEGPGPAPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGSPSPQPDSTDNDDYDDISAA

SEQ ID NO: 844831 - protein, 668 aa, Homo sapiens; identical to SEQ ID NO: 844824

SEQ ID NO: 844832 - protein, 601 aa, Homo sapiens [sequence omitted]

SEQ ID NO: 844833 - protein, 84 aa, Homo sapiens
PELEFLFPESSVTVKIENKESRELMLLIPSIVLGILLLGSLIFIAFILLRIKGKYGKCKVLGAMAIPGGCEPWQNPSSSGVVQQ

SEQ ID NO: 844834 - protein, 625 aa, Homo sapiens
MNAAVVRRTQEALGKVIRRPPLTEKLLSKPPFRYLHDIITEVIRMTGFMKGLYTDAEMKSDNVKDKDAKISFLQKAIDVVVMVSGEPLLAKPARIVAGHEPERTNELLQIIGKCCLNKLSSDDAVRRVLAGEKGEVKGRASLTSRSQELDNKNVREEESRVHKNTEDRGDAEIKERSTSRDRKQKEELKEDRKPREKDKDKEKAKENGGNRHREGERERAKARARPDNERQKDRGNRERDRDSERKKETERKSEGGKEKERLRDRDRERDRDKGKDRDRRRVKNGEHSWDLDREKNREHDKPEKKSASSGEMSKKLSDGTFKDSKAETETEISTRASKSLTTKTSKRRSKNSVEGDSTSDAEGDAGPAGQDKSEVPETPEIPNELSSNIRRIPRPGSARPAPPRVKRQDSMEALQMDRSGSGKTVSNVITESHNSDNEEDDQFVVEAAPQLSEMSEIEMVTAVELEEEEKHGGLVKKILETKKDYEKLQQSPKPGEKERSLFESAWKKEKDIVSKEIEKLRTSIQTLCKSALPLGKIMDYIQEDVDAMQNELQMWHSENRQHAEALQQEQRITDCAVEPLKAELAELEQLIKDQQDKICAVKANILKNEEKIQKMVYSINLTSRR

SEQ ID NO: 844835 - protein, 634 aa, Homo sapiens
MNAAVVRRTQEALGKVIRRPPLTEKLLSKPPFRYLHDIITEVGAGDRARQVIRMTGFMKGLYTDAEMKSDNVKDKDAKISFLQKAIDVVVMVSGEPLLAKPARIVAGHEPERTNELLQIIGKCCLNKLSSDDAVRRVLAGEKGEVKGRASLTSRSQELDNKNVREEESRVHKNTEDRGDAEIKERSTSRDRKQKEELKEDRKPREKDKDKEKAKENGGNRHREGERERAKARARPDNERQKDRGNRERDRDSERKKETERKSEGGKEKERLRDRDRERDRDKGKDRDRRRVKNGEHSWDLDREKNREHDKPEKKSASSGEMSKKLSDGTFKDSKAETETEISTRASKSLTTKTSKRRSKNSVEGDSTSDAEGDAGPAGQDKSEVPETPEIPNELSSNIRRIPRPGSARPAPPRVKRQDSMEALQMDRSGSGKTVSNVITESHNSDNEEDDQFVVEAAPQLSEMSEIEMVTAVELEEEEKHGGLVKKILETKKDYEKLQQSPKPGEKERSLFESAWKKEKDIVSKEIEKLRTSIQTLCKSALPLGKIMDYIQEDVDAMQNELQMWHSENRQHAEALQQEQRITDCAVEPLKAELAELEQLIKDQQDKICAVKANILKNEEKIQKMVYSINLTSRR

SEQ ID NO: 844836 - protein, 57 aa, Homo sapiens
LSSDDAVRRVLAGEKGEVKGRASLTSRSQELDNKNVREEESRVHKNTEVNSKSHIFE

SEQ ID NO: 844837 - protein, 37 aa, Homo sapiens
MEEGEGHRFQGDREAPHVHPDPVQERTSPGEDHGLHP

SEQ ID NO: 844838 - protein, 625 aa, Homo sapiens; identical to SEQ ID NO: 844834

SEQ ID NO: 844839 - protein, 205 aa, Homo sapiens
MNAAVVRRTQEALGKVIRRPPLTEKLLSKPPFRYLHDIITEVGAGDRARQVIRMTGFMKGLYTDAEMKSDNVKDKDAKISFLQKAIDVVVMVSGEPLLAKPARIVAGHEPERTNELLQIIGKCCLNKLSSDDAVRRVLAGEKGEVKGRASLTSRSQELDNKNVREEESRVHKNTEDRGDAEIKETVEDTSILYEERGSESWILKQ

SEQ ID NO: 844840 - protein, 136 aa, Homo sapiens
CCSHIPRCLRNPQKEIIEVFHHVAMPIVSSCSSASPIKISSGLTNYNQSLKAECQPALQRPCVPVPKGSSLKKQGTVLLGPTSRWKECTKSDLASGWPLSSPQGILQAVLLWSTSQWLWRQDSQWCSHKASPGPGP

SEQ ID NO: 844841 - protein, 270 aa, Homo sapiens
LLAFSGAARSQPETLLFFSGFGAVPDALGCRMSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSALQHPQLCTLPFLILANHQDKPAARSVQEEMQFHRVAQDGLKLLGSSHSTWRQAFPKTLQGCPYTLSPGPEFHYIIEQLRKFSQETNGGYHPESMDHTWDIEIPIAPVRILGPT

SEQ ID NO: 844842 - protein, 235 aa, Homo sapiens
LLAFSGAARSQPETLLFFSGFGAVPDALGCRMSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSALQHPQLCTLPFLILANHQDKPAARSVQEIKKYFELEPLARGKRWILQPCSLDDMDALKDSFSQLINLLEEKDHEAVRM

SEQ ID NO: 844843 - protein, 235 aa, Homo sapiens; identical to SEQ ID NO: 844842

SEQ ID NO: 844844 - protein, 142 aa, Homo sapiens
LLAFSGAARSQPETLLFFSGFGAVPDALGCRMSDLRITEAFLYMDYLCFRALCCKGPPPARPEYDLVCIGLTGSGKTSLLSKLCSESPDNVVSTTGFSIKAVPFQNAILNVKELGGITFQIISMSALNFYEFGNNVLYVIQT

SEQ ID NO: 844845 - protein, 118 aa, Homo sapiens
RDRARSSRLVGRCDEAASGPYVSTWGGAAPLRIPVHAEEWGFSPPPPPPSDLSRDTSHFPRDGSPRGPFGPLPLAGPTPRCRTVTLSPNASVSGVEWVPVVGAVEVSPVASAARTAVT

SEQ ID NO: 844846 - protein, 693 aa, Homo sapiens
MDTFPNNFPPGGDSGLTGSQSEFQKMLIDERLRCEHHKANYQTLKAEHTRLQNEHVKLQNELKHLFNEKQTQQEKLQLLLEELRGELVEKTKDLEEMKLQILTPQKLELLRAQIQQELETPMRERFRNLDEEVEKYRAVYNKLRYEHTFLKSEFEHQKEEYARILDEGKIKYESEIARLEEDKEELRNQLLNVDLTKDSKRVEQLAREKVYLCQKLKGLEAEVAELKAEKENSEAQVENAQRIQVRQLAEMQATVRSLEAEKQSANLRAERLEKELQSSSEQNTFLINKLHKAEREINTLSSKVKELKHSNKLEITDIKLETARAKSELERERNKIQSELDGLQSDNEILKAAVEHHKVLLVEKDRELIRKVQAAKEEGYQKLVVLQDEKLELENRLADLEKMKVEHDVWRQSEKDQYEEKLRASQMAEEITRKELQSVRLKLQQQIVTIENAEKEKNENSDLKQQISSLQIQVTSLAQSENDLLNSNQMLKEMVERLKQECRNFRSQAEKAQLEAEKTLEEKQIQWLEEKHKLHERITDREEKYNQAKEKLQRAAIAQKKRKSLHENKLKRLQEKVEVLEAKKEELETENQVLNRQNVPFEDYTRLQKRLKDIQRRHNEFRSLILVPNMPPTASINPVSFQSSAMVPSMELPFPPHMQEEQHQRELSLLRKRLEELETTQRKQLEELGSSGE

SEQ ID NO: 844847 - protein, 443 aa, Homo sapiens
MDTFPNNFPPGGDSGLTGSQSEFQKMLIDERLRCEHHKANYQTLKAEHTRLQNEHVKLQNELKHLFNEKQTQQEKLQLLLEELRGELVEKTKDLEEMKLQILTPQKLELLRAQIQQELETPMRERFRNLDEEVEKYRAVYNKLRYEHTFLKSEFEHQKEEYARILDEGKIKYESEIARLEEDKEELRNQLLNVDLTKDSKRVEQLAREKVYLCQKLKGLEAEVAELKAEKENSEAQVENAQRIQVERLKQECRNFRSQAEKAQLEAEKTLEEKQIQWLEEKHKLHERITDREEKYNQAKEKLQRAAIAQKKRKSLHENKLKRLQEKVEVLEAKKEELETENQVLNRQNVPFEDYTRLQKRLKDIQRRHNEFRSLILVPNMPPTASINPVSFQSSAMVPSMELPFPPHMQEEQHQRELSLLRKRLEELETTQRKQLEELGSSGE

SEQ ID NO: 844848 - protein, 568 aa, Homo sapiens
MHSPFEEVEKYRAVYNKLRYEHTFLKSEFEHQKEEYARILDEGKIKYESEIARLEEDKEELRNQLLNVDLTKDSKRVEQLAREKVYLCQKLKGLEAEVAELKAEKENSEAQVENAQRIQVRQLAEMQATVRSLEAEKQSANLRAERLEKELQSSSEQNTFLINKLHKAEREINTLSSKVKELKHSNKLEITDIKLETARAKSELERERNKIQSELDGLQSDNEILKAAVEHHKVLLVEKDRELIRKVQAAKEEGYQKLVVLQDEKLELENRLADLEKMKVEHDVWRQSEKDQYEEKLRASQMAEEITRKELQSVRLKLQQQIVTIENAEKEKNENSDLKQQISSLQIQVTSLAQSENDLLNSNQMLKEMVERLKQECRNFRSQAEKAQLEAEKTLEEKQIQWLEEKHKLHERITDREEKYNQAKEKLQRAAIAQKKRKSLHENKLKRLQEKVEVLEAKKEELETENQVLNRQNVPFEDYTRLQKRLKDIQRRHNEFRSLILVPNMPPTASINPVSFQSSAMVPSMELPFPPHMQEEQHQRELSLLRKRLEELETTQRKQLEELGSSGE

SEQ ID NO: 844849 - protein, 693 aa, Homo sapiens; identical to SEQ ID NO: 844846

SEQ ID NO: 844850 - protein, 110 aa, Homo sapiens
TNNKDNRREKKEGSFVARRGLTELQKRLKDIQRRHNEFRSLILVPNMPPTASINPVSFQSSAMVPSMELPFPPHMQEEQHQRELSLLRKRLEELETTQRKQLEELGSSGE

SEQ ID NO: 844851 - protein, 693 aa, Homo sapiens; identical to SEQ ID NO: 844846

SEQ ID NO: 844852 - protein, 701 aa, Homo sapiens
MVVSTFTDMDTFPNNFPPGGDSGLTGSQSEFQKMLIDERLRCEHHKANYQTLKAEHTRLQNEHVKLQNELKHLFNEKQTQQEKLQLLLEELRGELVEKTKDLEEMKLQILTPQKLELLRAQIQQELETPMRERFRNLDEEVEKYRAVYNKLRYEHTFLKSEFEHQKEEYARILDEGKIKYESEIARLEEDKEELRNQLLNVDLTKDSKRVEQLAREKVYLCQKLKGLEAEVAELKAEKENSEAQVENAQRIQVRQLAEMQATVRSLEAEKQSANLRAERLEKELQSSSEQNTFLINKLHKAEREINTLSSKVKELKHSNKLEITDIKLETARAKSELERERNKIQSELDGLQSDNEILKAAVEHHKVLLVEKDRELIRKVQAAKEEGYQKLVVLQDEKLELENRLADLEKMKVEHDVWRQSEKDQYEEKLRASQMAEEITRKELQSVRLKLQQQIVTIENAEKEKNENSDLKQQISSLQIQVTSLAQSENDLLNSNQMLKEMVERLKQECRNFRSQAEKAQLEAEKTLEEKQIQWLEEKHKLHERITDREEKYNQAKEKLQRAAIAQKKRKSLHENKLKRLQEKVEVLEAKKEELETENQVLNRQNVPFEDYTRLQKRLKDIQRRHNEFRSLILVPNMPPTASINPVSFQSSAMVPSMELPFPPHMQEEQHQRELSLLRKRLEELETTQRKQLEELGSSGE

SEQ ID NO: 844853 - protein, 742 aa, Homo sapiens
MKNRAKGPAAYSMLKPETSSDSPSARSKGVRLVSASVEINHIMAKGHDGRSNQRCSCVVIRVERLKEPLISNVDSRMMARVTSYEIVWATARSAPIRAQFEFDAHPDQRIEYTARLEVARINRRPRLRLTRAGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 844854 - protein, 530 aa, Homo sapiens
PPTPAQLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 844855 - protein, 487 aa, Homo sapiens
MRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 844856 - protein, 1884 aa, Homo sapiens
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGIISALEEDPVGQKLQLACRLQQVAALVENKVTDL

SEQ ID NO: 844857 - protein, 1563 aa, Homo sapiens
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKSGAQAWLVT

SEQ ID NO: 844858 - protein, 107 aa, Homo sapiens
SGSIMGAPSPPSSCLAPPLPPEQDSPVNKLLYAREIPRYKQMVERYYADIRQSSPASYQEMNSALAELSGNYTSAPHCLEALQELYNHIHRYYDQVAALVENKVTDL

SEQ ID NO: 844859 - protein, 66 aa, Homo sapiens
VFLHGSQGQVYHSQQVGPPGSAISPDLLLDSSGSHLYVLTAHQVRAILGLKGPAHAAQVSCPLPLC

SEQ ID NO: 844860 - protein, 1909 aa, Homo sapiens
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 844861 - protein, 1995 aa, Homo sapiens
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNRCLSCCPTPAVHMVTESQRDQDIPRVDAPTWGFWNLQEDLGPRSPRPPGQLPAAPGSECVASRLEYMGRRSRWQARASRPRLPCAPSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 844862 - protein, 2037 aa, Homo sapiens
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNRCLSCCPTPAVHMVTESQRDQDIPRVDAPTWGFWNLQEDLGPRSPRPPGQLPAAPGSECVASRLEYMGRRSRWQARASRPRLPCAPSLLLRFWVNALKNPQLIFDVRVSDNVDAILAVIAQTFIDSCTTSEHKVGRDSPVNKLLYAREIPRYKQMVERYYADIRQSSPASYQEMNSALAELSGEAWPGGCACPHVGGKTSRAEGGDLGLEDQAGTSLPPSTWCPQNYTSAPHCLEALQELYNHIHRYYDQIISALEEDPVGQKLQLACRLQQVAALVENKVTDL

SEQ ID NO: 844863 - protein, 1827 aa, Homo sapiens
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 844864 - protein, 1659 aa, Homo sapiens
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGESESLGPDLGPLESRLGR

SEQ ID NO: 844865 - protein, 82 aa, Homo sapiens
VKVRYLFKFTVLAVAACYSLHAASVMVENPALGKATTAWQERTQATCWLLQNTTHILEKSCSQDEWVGKRQEYLGLRVIIQF

SEQ ID NO: 844866 - protein, 863 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLMLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPALKYQQLFEDIRGQSDIAITKDMFEEALRALADDDFLTVTGKTVRLL

SEQ ID NO: 844867 - protein, 863 aa, Homo sapiens; identical to SEQ ID NO: 844866

SEQ ID NO: 844868 - protein, 863 aa, Homo sapiens; identical to SEQ ID NO: 844866

SEQ ID NO: 844869 - protein, 846 aa, Homo sapiens
LFCVTQARSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLMLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPALKYQQLFEDIRGQSDIAITKDMFEEALRALADDDFLTVTGKTVRLL

SEQ ID NO: 844870 - protein, 863 aa, Homo sapiens; identical to SEQ ID NO: 844866

SEQ ID NO: 844871 - protein, 913 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKGVTFCLYCCTSLEFVLKLLQGACFLEKDVVIAHIHLNSVLGMNLRTGLIQAGIICQLNARTSVLAAANPIESQWNPKKTTIENIQLPHTLLSRFDLIFLMLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPALKYQQLFEDIRGQSDIAITKDMFEEALRALADDDFLTVTGKTVRLL

SEQ ID NO: 844872 - protein, 845 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIVLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPALKYQQLFEDIRGQSDIAITKDMFEEALRALADDDFLTVTGKTVRLL

SEQ ID NO: 844873 - protein, 670 aa, Homo sapiens
MQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLMLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPALKYQQLFEDIRGQSDIAITKDMFEEALRALADDDFLTVTGKTVRLL

SEQ ID NO: 844874 - protein, 819 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLMLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPALKYQQLFEDIRGQSDIAITKDMFEEALRALADDDFLTVTGKTVRLL

SEQ ID NO: 844875 - protein, 527 aa, Homo sapiens [sequence omitted]

SEQ ID NO: 844876 - protein, 740 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLMLDPQDEAYDRRLAHHLVALYYQSEEQAEEELLDMAVLKDYIAYAHSTIMPRLSEEASQALIEAHAGPSGRNLYKRLAHPPVAQYYTERGR

SEQ ID NO: 844877 - protein, 543 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKLERIFTHRAHFGCPKYFGRGPRARHLGHTGAGGKLLELRIKLLAVIGNPWYPASSHGELSVYTMY

SEQ ID NO: 844878 - protein, 442 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMVRSHPGPPGYALPVCILKRPTITCPSDPEPHFPNGIHPSLVLWVSLVAYGLNMQSTQSPCFRALSLCCCQWHCLLLETLYFHGLKCFKRLR

SEQ ID NO: 844879 - protein, 863 aa, Homo sapiens; identical to SEQ ID NO: 844866

SEQ ID NO: 844880 - protein, 863 aa, Homo sapiens; identical to SEQ ID NO: 844866

SEQ ID NO: 844881 - protein, 863 aa, Homo sapiens; identical to SEQ ID NO: 844866

SEQ ID NO: 844882 - protein, 863 aa, Homo sapiens; identical to SEQ ID NO: 844866

SEQ ID NO: 844883 - protein, 863 aa, Homo sapiens; identical to SEQ ID NO: 844866

SEQ ID NO: 844884 - protein, 863 aa, Homo sapiens; identical to SEQ ID NO: 844866

SEQ ID NO: 844885 - protein, 863 aa, Homo sapiens; identical to SEQ ID NO: 844866

SEQ ID NO: 844886 - protein, 670 aa, Homo sapiens; identical to SEQ ID NO: 844873

SEQ ID NO: 844887 - protein, 657 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRLAVAGEWFLHTLDS

SEQ ID NO: 844888 - protein, 853 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLMLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPCNPSTLGGQCGWIMRSGVQDQPSQDGETPSLVKITKN

SEQ ID NO: 844889 - protein, 394 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGLI

SEQ ID NO: 844890 - protein, 761 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLMLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVPLKPCGIL

SEQ ID NO: 844891 - protein, 350 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQIKLQESPEDMPAGQTPHTVILFAHNDLVDKVQPGDRVNVTGLI

SEQ ID NO: 844892 - protein, 184 aa, Homo sapiens
RILAFACSKMAAVSMSVVLRQTLWRRRAVAVAALSVSRVPTRSLRTSTWRLAQDQTQDTQLITVDEKLDITTLTGVPEEHIKTRKVRIFVPARNNMQSGVNNTKKWKMEFDTRERWENPLMGWASTADPLSNMVLTFSTKEDAVSFAEKNGWSYDIEERKVPKPKSKSYGANFSWNKRTRVSTK

SEQ ID NO: 844893 - protein, 184 aa, Homo sapiens; identical to SEQ ID NO: 844892

SEQ ID NO: 844894 - protein, 241 aa, Homo sapiens
RILAFACSKMAAVSMSVVLRQTLWRRRAVAVAALSVSRVPTRSLRTSTWRLAQDQTQDTQLITVDEKLVYLVPLCFTFCGLATPSLELATLFPASRHLEFLFTLPGCILTNPEDFSGHHLPILQMDITTLTGVPEEHIKTRKVRIFVPARNNMQSGVNNTKKWKMEFDTRERWENPLMGWASTADPLSNMVLTFSTKEDAVSFAEKNGWSYDIEERKVPKPKSKSYGANFSWNKRTRVSTK

SEQ ID NO: 844895 - protein, 187 aa, Homo sapiens
PGLQEFGTKQEAAVSIASGTKPTVCRKKPKGLNLPFPFTRFPPRLVEPFPHEVGQGPSLNPHILIPFIENIDITTLTGVPEEHIKTRKVRIFVPARNNMQSGVNNTKKWKMEFDTRERWENPLMGWASTADPLSNMVLTFSTKEDAVSFAEKNGWSYDIEERKVPKPKSKSYGANFSWNKRTRVSTK

SEQ ID NO: 844896 - protein, 116 aa, Homo sapiens
RGPRLRDPARRPEGKLKVRIFVPARNNMQSGVNNTKKWKMEFDTRERWENPLMGWASTADPLSNMVLTFSTKEDAVSFAEKNGWSYDIEERKVPKPKSKSYGANFSWNKRTRVSTK

SEQ ID NO: 844897 - protein, 129 aa, Homo sapiens
RILAFACSKMAAVSMSVVLRQTLWRRRAVAVAALSVSRVPTRSLRTSTWRLAQDQTQDTQLITVDEKLDITTLTGVPEEHIKTRKVRIFVPARNNMQSGVNNTKKWKMEFDTRERWENPLMGWASTMEL

SEQ ID NO: 844898 - protein, 166 aa, Homo sapiens
RILAFACSKMAAVSMSVVLRQTLWRRRAVAVAALSVSRVPTRSLRTSTWRLAQDQTQDTQLITVDEKLDITTLTGVPEEHIKTRKVRIFVPARNNMQSGVNNTKKWKMEFDTRERWVTFSTKEDAVSFAEKNGWSYDIEERKVPKPKSKSYGANFSWNKRTRVSTK

SEQ ID NO: 844899 - protein, 188 aa, Homo sapiens
RILAFACSKMAAVSMSVVLRQTLWRRRAVAVAALSVSRVPTRSLRTSTWRLAQDQTQDTQLITVDEKLDITTLTGVPEEHIKTRKVRIFVPARNNMQSGVNNTKKWKMEFDTRERWENPLMGWASTADPLSNMVLTFSTKEDAVSFAEKNGWSYDIEERKVPKPKSKSYGANFSWNKRTRVAVFIVHV

SEQ ID NO: 844900 - protein, 177 aa, Homo sapiens
RILAFACSKMAAVSMSVVLRQTLWRRRAVAVAALSVSRVPTRSLRTSTWRLAQDQTQDTQLITVDEKLDITTLTGVPEEHIKTRKVRIFVPARNNMQSGVNNTKKWKMEFDTRERWENPLMGWASTADPLSNMVLTFSTKEDAVSFAEKNGWSYDIEERKVPPQNRLALTISLLDCE

SEQ ID NO: 844901 - protein, 128 aa, Homo sapiens
GGLNVSGTEADVVAEKGSGCSCPFRFQGSDQVIEFSHFSSSFLGPSIFAESLLAEFRRRPRGRRPLLTLFSGEVGRTRDCLLSMGVGQASEGVSARPGRRTCGFLEAFVFGLSLRERVRGGFASGAAS

SEQ ID NO: 844902 - protein, 1071 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 844903 - protein, 1071 aa, Homo sapiens; identical to SEQ ID NO: 844902

SEQ ID NO: 844904 - protein, 1071 aa, Homo sapiens; identical to SEQ ID NO: 844902

SEQ ID NO: 844905 - protein, 1012 aa, Homo sapiens
MAQEVLTHLKEHPDAWTRVDTILEFSQNMNTKYYGLQILENVIKTRWKILPRNQCEGIKKYVVGLIIKTSSDPTCVEILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 844906 - protein, 856 aa, Homo sapiens
SVVSAEVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 844907 - protein, 1071 aa, Homo sapiens; identical to SEQ ID NO: 844902

SEQ ID NO: 844908 - protein, 776 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMKCPSC

SEQ ID NO: 844909 - protein, 894 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGK

SEQ ID NO: 844910 - protein, 1071 aa, Homo sapiens; identical to SEQ ID NO: 844902

SEQ ID NO: 844911 - protein, 1071 aa, Homo sapiens; identical to SEQ ID NO: 844902

SEQ ID NO: 844912 - protein, 1071 aa, Homo sapiens; identical to SEQ ID NO: 844902

SEQ ID NO: 844913 - protein, 165 aa, Homo sapiens
ILAYMFNLVELMHAGVNQQYVKCLSQQKRYAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 844914 - protein, 946 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGKNLIRFKC

SEQ ID NO: 844915 - protein, 920 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLPNFRDHLLDQRIEWDPLNA

SEQ ID NO: 844916 - protein, 205 aa, Homo sapiens
GEAAAAAAAGAAGATASARATVATAPAAVPVPVFAAAVRATTQRGRGEPPVAEEQEKGGKFRRALGGGGPAPEPRERGSRVLVGGSRTATGSRASPRPCGLYTSYSCRFCCCLWLEGPPGAESLGLDPVPSPFPHSPAGREHLFPRLIPLLGGGGCVCVCVSGRPGCQYWQASRGPSVCAEHCGQDRQCWAPHNHGRDCLTSRGS

SEQ ID NO: 844917 - protein, 110 aa, Homo sapiens
RSGCSGRGRSSGSYSISKSNSSYSPGGGACSSLCCCSPCNHPAGREHLFPRLIPLLGGGGCVCVCVSGRPGCQYWQASRGPSVCAEHCGQDRQCWAPHNHGRDCLTSRGS

SEQ ID NO: 844918 - protein, 198 aa, Homo sapiens
GEAAAAAAAGAAGATASARATVATAPAAVPVPVFAAAVRATTQRGRGEPPVAEEQEKGGKFRRAPEPRERGSRVLVGGSRTATGSRASPRPCGLYTSYSCRFCCCLWLEGPPGAESLGLDPVPSPFPHSPAGREHLFPRLIPLLGGGGCVCVCVSGRPGCQYWQASRGPSVCAEHCGQDRQCWAPHNHGRDCLTSRGS

SEQ ID NO: 844919 - protein, 1056 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 844920 - protein, 813 aa, Homo sapiens [sequence omitted]

SEQ ID NO: 844921 - protein, 431 aa, Homo sapiens [sequence omitted]

SEQ ID NO: 844922 - protein, 432 aa, Homo sapiens [sequence omitted]

SEQ ID NO: 844923 - protein, 356 aa, Homo sapiens
VGEPIQILTLKFPFLQFAYFKSMVLVTISPLAWIAVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 844924 - protein, 1071 aa, Homo sapiens; identical to SEQ ID NO: 844902

SEQ ID NO: 844925 - protein, 283 aa, Homo sapiens
GGRYARHAAEYVDSPNDGIQNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 844926 - protein, 991 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQE

SEQ ID NO: 844927 - protein, 894 aa, Homo sapiens; identical to SEQ ID NO: 844909

SEQ ID NO: 844928 - protein, 788 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMPKFGPPCGSVYGFKKGP

SEQ ID NO: 844929 - protein, 815 aa, Homo sapiens
RARRVAASGAGREKRKGGGPAGEEGRRRRFGRLCGVRSVAGTERSSWARRPGQLGPGPRFGRAGRAGLAIMEEELQHSHCVNCVSRRCMTRPEPGISCDLIGCPLVCGAVFHSCKADEHRLLCPFERVPCLNSDFGCPFTMARNKVAEHLEMCPASVVCCTMEWNRWPVSYADRKSYENLSRDVDEVAQLDMALALQDQRMLLESLKVATMMSKATDKVSKPREQISVKSSVPEIPHANGLVSVDEESYGALYQATVETTRSLAAALDILNTATRDIGMLNTSVPNDMDEQQNARESLEDQNLKDQDHLYEEEIGAVGGIDYNDTNQNAQSEQNGSSDLLCDLNTSSYDTSALCNGFPLENICTQVIDQNQNLHGDSKQSNLTNGDCVASSDGTSKPSSSLAVAAQLREIIPSSALPNGTVQHILMPDDEGEGELCWKKVDLGDVKNVDVLSFSHAPSFNFLSNSCWSKPKEDKAVDTSDLEVAEDPMGLQGIDLITAALLFCLGDSPGGRGISDSRMADIYHIDVGTQTFSLPSAILATSTMVGEIASASACDHANPQLSNPSPFQTLGLDLVLECVARYQPKQRSMFTFVCGQLFRRKEFSSHFKNVHGDIHAGLNGWMEQRCPLAYYGCTYSQRRFCPSIQGAKIIHDRHLRSFGVQPCVSTVLVEPARNCVLGLHNDHLSSLPFEVLQHIAGFLDGFSLCQLSCVSKLMRDVCGSLLQSRGMVILQWGKRKYPEGNSSWQIKEKVWRFSTAFCSVNEWKFADILSMADHLKKCSYNVVEKREEAIPLPCMCVTRELTKEGRSLRSVLKPVL

SEQ ID NO: 844930 - protein, 815 aa, Homo sapiens; identical to SEQ ID NO: 844929

SEQ ID NO: 844931 - protein, 815 aa, Homo sapiens; identical to SEQ ID NO: 844929

SEQ ID NO: 844932 - protein, 750 aa, Homo sapiens
RARRVAASGAGREKRKGGGPAGEEGRRRRFGRLCGVRSVAGTERSSWARRPGQLGPGPRFGRAGRAGLAIMEEELQHSHCVNCVSRRCMTRPEPGISCDLIGCPLVCGAVFHSCKADEHRLLCPFERVPCLNSDFGCPFTMARNKVAEHLEMCPASVVCCTMEWNRWPVSYADRKSYENLSRDVDEVAQLDMALALQDQRMLLESLKVATMMSKATDKVSKPREQISVKSSVPEIPHANGLVSVDEESYGALYQATVETTRSLAAALDILNTATRDIGMLNTSVPNDMDEQQNARESLEDQNLKDQDHLYEEEIGAVGGIDYNDTNQNAQSEQNGSSDLLCDLNTSSYDTSALCNGFPLENICTQVIDQNQNLHGDSKQSNLTNGDCVASSDGTSKPSSSLAVAAQLREIIPSSALPNGTVQHILMPDDEGEGELCWKKVDLGDVKNVDVLSFSHAPSFNFLSNSCWSKPKEDKAVDTSDLEVAEDPMGLQGIDLITAALLFCLGDSPGGRGISDSRMADIYHIDVGTQTFSLPSAILATSTMVGEIASASACDHANPQLSNPSPFQTLGLDLVLECVARYQPKQRSMFTFVCGQLFRRKEFSSHFKNVHGDIHAGLNGWMEQRCPLAYYGCTYSQRRFCPSIQGAKIIHDRHLRSFGVQPCVSTVLVEPARNCVLGLHNDHLSSLPFEVLQHIAGFLDGFSLCQLSCVSKLMRDVCGSLLQSRGMVILQWGKRKYPEGNSSWQIKEKIC

SEQ ID NO: 844933 - protein, 352 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPQDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLELEQYKRSSSKSWKQIELDS

SEQ ID NO: 844934 - protein, 144 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRSWQLSSLLPVSMNLTTPVPHINEIIHYLSFCYLFHLA

SEQ ID NO: 844935 - protein, 335 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPQDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLVLS

SEQ ID NO: 844936 - protein, 189 aa, Homo sapiens
MPKDHPQDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLELEQYKRSSSKSWKQIELDS

SEQ ID NO: 844937 - protein, 347 aa, Homo sapiens
PRRPHSQTPCGARRLILGWSLLRACDVCGSQAVDDAQGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPQDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLELEQYKRSSSKSWKQIELDS

SEQ ID NO: 844938 - protein, 154 aa, Homo sapiens
MSTQRSVKTLDSVHIIMEHHYFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLELEQYKRSSSKSWKQIELDS

SEQ ID NO: 844939 - protein, 200 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPQDHELIDPFPVPLVIIGSKYDVFQVSSSASS

SEQ ID NO: 844940 - protein, 201 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPVSCCLGLLLESLVPFIVNDNITNNFFRFLCMT

SEQ ID NO: 844941 - protein, 335 aa, Homo sapiens; identical to SEQ ID NO: 844935

SEQ ID NO: 844942 - protein, 335 aa, Homo sapiens; identical to SEQ ID NO: 844935

SEQ ID NO: 844943 - protein, 334 aa, Homo sapiens
MPSETLWEIAKAEVEKRGINGSEGDGAEIAEKFVFFIGSKNGGKTTIILRCLDRDEPPKPTLALEYTYGRRAKGHNTLISIPITGDTLRTFSLVLVLDLSKPNDLWPTMENLLQATKSHVDKVIMKLGKTNAKAVSEMRQKIWNNMPKDHPQDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLELEQYKRSSSKSWKQIELDS

SEQ ID NO: 844944 - protein, 134 aa, Homo sapiens [sequence omitted]

SEQ ID NO: 844945 - protein, 185 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATSINTLKDIKDPARDPQYAENEVDEMRIQKDLELEQYKRSSSKSWKQIELDS

SEQ ID NO: 844946 - protein, 746 aa, Homo sapiens
TRDGRHAPRSIVSLIWVPGRCGRRAGSARVTPAAGAPGPAGAGRGVPGRAAAMKHLKRWWSAGGGLLHLTLLLSLAGLRVDLDLYLLLPPPTLLQDELLFLGGPASSAYALSPFSASGGWGRAGHLHPKGRELDPAAPPEGQLLREVRALGVPFVPRTSVDAWLVHSVAAGSADEAHGLLGAAAASSTGGAGASVDGGSQAVQGGGGDPRAARSGPLDAGEEEKAPAEPTAQVPDAGGCASEENGVLREKHEAVDHSSQHEENEERVSAQKENSLQQNDDDENKIAEKPDWEAEKTTESRNERHLNGTDTSFSLEDLFQLLSSQPENSLEGISLGDIPLPGSISDGMNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSEPFPWPGKSQKIRSRYLEDTDRNLSRDEQRAKALHIPFSVDEIVGMPVDSFNSMLSRYYLTDLQVSLIRDIRRRGKNKVAAQNCRKRKLDIILNLEDDVCNLQAKKETLKREQAQCNKAINIMKQKLHDLYHDIFSRLRDDQGRPVNPNHYALQCTHDGSILIVPKELVASGHKKETQKGKRK

SEQ ID NO: 844947 - protein, 746 aa, Homo sapiens; identical to SEQ ID NO: 844946

SEQ ID NO: 844948 - protein, 657 aa, Homo sapiens
TRDGRHAPRSIVSLIWVPGRCGRRAGSARVTPAAGAPGPAGAGRGVPGRAAAMKHLKRWWSAGGGLLHLTLLLSLAGLRVDLDLYLLLPPPTLLQDELLFLGGPASSAYALSPFSASGGWGRAGHLHPKGRELDPAAPPEGQLLREVRALGVPFVPRTSVDAWLVHSVAAGSADEAHGLLGAAAASSTGGAGASVDGGSQAVQGGGGDPRAARSGPLDAGEEEKAPAEPTAQVPDAGGCASEENGVLREKHEAVDHSSQHEENEERVSAQKENSLQQNDDDENKIAEKPDWEAEKTTESRNERHLNGTDTSFSLEDLFQLLSSQPENSLEGISLGDIPLPGSISDGMNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSEPFPWPGKSQKIRSRYLEDTDRNLSRDEQRAKALHIPFSVDEIVGMPVDSFNSMLSRYYLTDLQVSLIRDIRRRGKNKVAAQNFPGQHPPHQTH

SEQ ID NO: 844949 - protein, 345 aa, Homo sapiens
TRDGRHAPRSIVSLIWVPGRCGRRAGSARVTPAAGAPGPAGAGRGVPGRAAAMKHLKRWWSAGGGLLHLTLLLSLAGLRVDLDLYLLLPPPTLLQDELLFLGGPASSAYALSPFSASGGWGRAGHLHPKGRELDPAAPPEGQLLREVRALGVPFVPRTSVDAWLVHSVAAGSADEAHGLLGAAAASSTGGAGASVDGGSQAVQGGGGDPRAARSGPLDAGEEEKAPAEPTAQVPDAGGCASEENGVLREKHEAVDHSSQHEENEERVSAQKENSLQQNDDDENKIAEKPDWEAEKTTESRNERHLNGTDTSFSLEDLFQLLSSQPENSLEVIGTLAFILAGTYLH

SEQ ID NO: 844950 - protein, 746 aa, Homo sapiens; identical to SEQ ID NO: 844946

SEQ ID NO: 844951 - protein, 400 aa, Homo sapiens
MNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSEPFPWPGKSQKIRSRYLEDTDRNLSRDEQRAKALHIPFSVDEIVGMPVDSFNSMLSRYYLTDLQVSLIRDIRRRGKNKVAAQNCRKRKLDIILNLEDDVCNLQAKKETLKREQAQCNKAINIMKQKLHDLYHDIFSRLRDDQGRPVNPNHYALQCTHDGSILIVPKELVASGHKKETQKGKRK

SEQ ID NO: 844952 - protein, 684 aa, Homo sapiens
TRDGRHAPRSIVSLIWVPGRCGRRAGSARVTPAAGAPGPAGAGRGVPGRAAAMKHLKRWWSAGGGLLHLTLLLSLAGLRVDLDLYLLLPPPTLLQDELLFLGGPASSAYALSPFSASGGWGRAGHLHPKGRELDPAAPPEGQLLREVRALGVPFVPRTSVDAWLVHSVAAGSADEAHGLLGAAAASSTGGAGASVDGGSQAVQGGGGDPRAARSGPLDAGEEEKAPAEPTAQVPDAGGCASEENGVLREKHEAVDHSSQHEENEERVSAQKENSLQQNDDDENKIAEKPDWEAEKTTESRNERHLNGTDTSFSLEDLFQLLSSQPENSLEGISLGDIPLPGSISDGMNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSEPFPWPGKSQKIRSRYLEDTDRNLSRDEQRAKALHIPFSVDEIVGMPVDSFNSMLSRYYLTDLQVSLIRDIRRRGKNKVAAQNCRKRKLDIILNLEDDVCNLQAKKETLKREQAQCNKRLT

SEQ ID NO: 844953 - protein, 406 aa, Homo sapiens
SALEVPSRAATPLQAGPPTRPARSALRPGPAADPRPAARFAPEACAPTDARAQLATPTPGAPTAEDSPRCRRRGWLAAQAAPDVPGSPPPPLQPRPPWPGSRRPPWVASASSACSSLARCPAAWAGTRDPSNPGSPQPGALPAACSPGTPHPDLWSGSFTGPSRHRGVPAWPLLWVSLSGMVAANTRAPAGPKPSSCEWAACWAPARCRISATACGNSWDRPAGRTQLLWTPAAPTAMAEVGPGHTPAHPSQGAVPPSRAAAEPHLKPSPSELQTAGPAATIPARLCTRKPRLVYTQCWYVKEPKHPEIVTPWGTAARHSWRQHQMLSASERRCLPRDVEQKLGPEHTGPCLDEQGREAELARSGPSAAGPVRLKPGLVPGLFLLSCTTSPSTCLPVGQEGERGML

SEQ ID NO: 844954 - protein, 159 aa, Homo sapiens
MLRNNKTIIIKYFLNLINGAFLVLGLLFMGFGAWLLLDRNNFLTAFDENNHFIVPISQILIGMGSSTVLFCLLGYIGIHNEIRWLLIVVESRSVTRLECSGTISAHCNLHLPDSSDSPASDSEVAGITVCSIDNMDLCCSGCTFSIHHHKERGGSATMA

SEQ ID NO: 844955 - protein, 159 aa, Homo sapiens; identical to SEQ ID NO: 844954

SEQ ID NO: 844956 - protein, 248 aa, Homo sapiens
MLRNNKTIIIKYFLNLINGAFLVLGLLFMGFGAWLLLDRNNFLTAFDENNHFIVPISQILIGMGSSTVLFCLLGYIGIHNEIRWLLIVYAVLITWTFAVQVVLSAFIITKKEEVQQLWHDKIDFVISEYGSKDKPEDITKWTILNALQKTLQCCGQHNYTDWIKNKNKENSGQVPCSCTKSTLRKWFCDEPLNATYLEGCENKISAWYNVNVLTLIGINFGLLTSEVFQVSLTVCFFKNIKNIIHAEM

SEQ ID NO: 844957 - protein, 1120 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKGKNSKKSHSFPPMNRDHRRIIHDLAQVYGLESVSYDSEPKRNVVVTAIRGKSVCPPTTLTGVLEREMQARPPPPIPHHRHQSDKNPGSSNLQKITKEPIIDYFDVQD

SEQ ID NO: 844958 - protein, 1104 aa, Homo sapiens
MEFSSICIEFKSTLRQEAPPPSRAAEPEIELYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKGKNSKKSHSFPPMNRDHRRIIHDLAQVYGLESVSYDSEPKRNVVVTAIRGKSVCPPTTLTGVLEREMQARPPPPIPHHRHQSDKNPGSSNLQKITKEPIIDYFDVQD

SEQ ID NO: 844959 - protein, 921 aa, Homo sapiens
MCHSAGWVVIWPGPVYKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKVEVETSHWTFL

SEQ ID NO: 844960 - protein, 833 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEQSHYWASTQKKRSHYMKKIPAHACL

SEQ ID NO: 844961 - protein, 409 aa, Homo sapiens
MDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKVEVETSHWTFL

SEQ ID NO: 844962 - protein, 557 aa, Homo sapiens
TKARYEAGVESAEAVPHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKVEVETSHWTFL

SEQ ID NO: 844963 - protein, 117 aa, Homo sapiens
METLVEAVNKGKNSKKSHSFPPMNRDHRRIIHDLAQVYGLESVSYDSEPKRNVVVTAIRGKSVCPPTTLTGVLEREMQARPPPPIPHHRHQSDKNPGSSNLQKITKEPIIDYFDVQD

SEQ ID NO: 844964 - protein, 693 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKLLK

SEQ ID NO: 844965 - protein, 696 aa, Homo sapiens [sequence omitted]

SEQ ID NO: 844966 - protein, 548 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQGKWWAHQLAMLVFFSGTLL

SEQ ID NO: 844967 - protein, 476 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPAHLPEWAPEGI

SEQ ID NO: 844968 - protein, 131 aa, Homo sapiens
RYLSESQTSRSHPALINQFSEGGAQDSDFKHTPRKILIQVEVRSPGLEAARPPFMVGPGPAGNVRATPDLHCDSAAEGGLEEMVEELNSGKVMYAFCRVKDPNSGLPKFVLINWTGEGNRARLRLEKKNKF

SEQ ID NO: 844969 - protein, 165 aa, Homo sapiens
MAEAPPVSGTFKFNTDAAEFIPQEKKNSGLNCGTQRRLDSNRIGRRNYSSPPPCHLSRQVPYDEISAVHQHSYHRGGGGGRGGGGGGGEEGGRGERAEGGEGGGGESGQRRRGAGGRGGGGGRGGEGGGGGRGGGGGGAGGEGGGAGEGAGGGGAGEGGGPGGGG

SEQ ID NO: 844970 - protein, 1024 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKVEVETSHWTFL

SEQ ID NO: 844971 - protein, 691 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKRNGCVDGINVMRYAVWIRSTSVL

SEQ ID NO: 844972 - protein, 578 aa, Homo sapiens
MAVVYSVKPFSFSLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKVEVETSHWTFL

SEQ ID NO: 844973 - protein, 215 aa, Homo sapiens
LRLGTRLVWNSAEAVPDMQLGGSVEISKLITKKEVHQARLECDEECSALERKKRLAEAFHISEDSDPFNIRSSGSKFSDSLKEDARKDLKFVSDVEKEMETLVEAVNKGKNSKKSHSFPPMNRDHRRIIHDLAQVYGLESVSYDSEPKRNVVVTAIRGKSVCPPTTLTGVLEREMQARPPPPIPHHRHQSDKNPGSSNLQKITKEPIIDYFDVQD

SEQ ID NO: 844974 - protein, 743 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVVSGLIRHNQIPFIQVLGFWKPEPCGECSPDLKVTGTGP

SEQ ID NO: 844975 - protein, 476 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPASMSFSGTSRA

SEQ ID NO: 844976 - protein, 384 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSKTPSRKKK

SEQ ID NO: 844977 - protein, 115 aa, Homo sapiens
KVHVTLRLKRRMKTPQARFYDFLFTLKSPMNYRFQPWRFVPYYETVTVTQIDERFCRTTKVKDVDPELEASTDTDGVDCDENAHVIVLSSDNQCNMKTDYRRKEQIKSINQAYLC

SEQ ID NO: 844978 - protein, 183 aa, Homo sapiens
ILFTLAGWFHSFPGFSLALFSGTSLISFSLFPAFWSLLVSNPGNNNNTNIFSPSCIPTLNWPSQPQPGFCPTQVFLGERGKANLGSKEASLWDQCPLGDDNEIGLDKTLSSSHWPHLQSLCDPSGLGLRAKPQAGGAWGKQIPQLLKLWGGEQSSSTKLWFTLLWLSAPKILELSLKTSEEEI

SEQ ID NO: 844979 - protein, 332 aa, Homo sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 844980 - protein, 298 aa, Homo sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIVVTMGLFRTIALFYLGSFDSIVRRCMMQREKSENADKTA

SEQ ID NO: 844981 - protein, 332 aa, Homo sapiens; identical to SEQ ID NO: 844979

SEQ ID NO: 844982 - protein, 304 aa, Homo sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIQGNFNSSLGSDGYMLSALTCGMAPVTSITEGLQQRWVTNGAFSRN

SEQ ID NO: 844983 - protein, 332 aa, Homo sapiens; identical to SEQ ID NO: 844979

SEQ ID NO: 844984 - protein, 341 aa, Homo sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKIAAKWDPIFGL

SEQ ID NO: 844985 - protein, 181 aa, Homo sapiens
HEEAVLKSSVLTFGNAAVTLSLRSTALKSCLPLALEPASFFTMREKAGGSTDVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 844986 - protein, 102 aa, Homo sapiens
MLLLAAAFLVAFVLLLYMVSPLISPKPLALPGAHVVVTGGSSGIGKCIAIECYKQGAFITLVARNEDKLLQAKKEIEMHSINDKQVNLCLQNAFSVKLSTAV

SEQ ID NO: 844987 - protein, 1285 aa, Homo sapiens
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRNDGTRPKMTPEQMAKEMSEFLSRGPAVLATKAAAGTKKYDLSKWKYAELRDTINTSCDIELLAACREEFHRRLKVYHAWKSKNKKRNTETEQRAPKSVTDYDFAPFLNNSPQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 844988 - protein, 1253 aa, Homo sapiens
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYAQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 844989 - protein, 752 aa, Homo sapiens
MPGLKNTLDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYAQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 844990 - protein, 583 aa, Homo sapiens
HSQIILDFRTVIDSALCLFVNLGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYAQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 844991 - protein, 1302 aa, Homo sapiens
SMLNSLWVSMRDCRASVSSGSAPRKRSVCRNSGIVDPPSKMEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYDFAPFLNNSPQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 844992 - protein, 1057 aa, Homo sapiens
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRSACENVTDQMPGQWQECKFDES

SEQ ID NO: 844993 - protein, 1302 aa, Homo sapiens; identical to SEQ ID NO: 844991

SEQ ID NO: 844994 - protein, 1284 aa, Homo sapiens
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKRFCFSWSSPARDGYRGLVELREESRHSQGLQTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYAQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 844995 - protein, 541 aa, Homo sapiens
MGNHPASSPKQTPSLNTEAELFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYAQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 844996 - protein, 1302 aa, Homo sapiens; identical to SEQ ID NO: 844991

SEQ ID NO: 844997 - protein, 600 aa, Homo sapiens
SNSCSKNEIDIDAFRHYSFSDQPKCSQYISGLMSVQWTPRMRPSCSRSLESLRVGAKPPPFQRWPSDSWIRCGAHRDWDEPPPRGGRMDGWSGDRARAAAPTGLQPPGCKDHGCSSGSPFRDPAGSSVIRSGKGDRPEGPSFLRPPAVTVKKLQKWMYKGRLLSLGMKGRARGTAPKVTGTQAASPNVGALKVRENRVLSVPPDQRITLTDLFENAYGSSMKGRELEELKDNIEFRGHKPLNSITVSKKRNWLYQSTLRPLNLEEENKKCQDRSHLSISPVSLPKHQLSQSFLKSSKEYCTYVVCNATNSSLSKNCALDFNEENDADDEGEIWYNPIPEDDDLGISSALSFGEADSAVLKLPAVNLSMLSGSDLMKAERHTEDSLCSSEHAGDIQTTRSNGMNPIHPAHSTEFVQQYKQKLGHKTQEGIMVEDSPMLKSPFAGSGILAATNSTELGIMEPSSPNPSPVKKGSSINWSLPDKIKSPRTVRKLSMKMKKLPEFSRKLSVKGTLNYINSPDNTPSLSKYNCREIHHTDILPSGNTTTAAKRNVISRYHLDTSVSSQQSYQKKNSMSSKYSCKGGYLSDGDSPELTTKASKHGS

SEQ ID NO: 844998 - protein, 579 aa, Homo sapiens
RLRTQLREAYYLLIQAMHDLPPDSGARRGGRGLADHSFPAGARAPGQPPSRGAAYRRACPRDGERGGGGRPRQQVSPPRSPQREPRGGQLRTPRMRPSCSRSLESLRVGAKPPPFQRWPSDSWIRCGAHRDWDEPPPRGGRMDGWSGDRARAAAPTGLQPPGCKDHGCSSGSPFRDPAGSSVIRSGKGDRPEGPSFLRPPAVTVKKLQKWMYKGRLLSLGMKGRARGTAPKVTGTQAASPNVGALKVRENRVLSVPPDQRITLTGRILCDENASTASLTVYRLGFCLKSQEKVMFLRQTMAGRIEVVISSRKTSVSIPKVLPKGDKDLFENAYGSSMKGRELEELKDNIEFRGHKPLNSITVSKKRNWLYQSTLRPLNLEEENKKCQDRSHLSISPVSLPKHQLSQSFLKSSKEYCTYVVCNATNSSLSKNCALDFNEENDADDEGEIWYNPIPEDDDLGISSALSFGEADSAVLKLPAVNLSMLSGSDLMKAERHTEDSLCSSEHAGDIQTTRSNGMNPIHPAHSTEFVQQYKQKLGHKTQEGIMVEDSPMLKSPFAGKNDHICVFLSSSIFELFDNS

SEQ ID NO: 844999 - protein, 551 aa, Homo sapiens
RLRTQLREAYYLLIQAMHDLPPDSGARRGGRGLADHSFPAGARAPGQPPSRGAAYRRACPRDGERGGGGRPRQQVSPPRSPQREPRGGQLRTPRMRPSCSRSLESLRVGAKPPPFQRWPSDSWIRCGAHRDWDEPPPRGGRMDGWSGDRARAAAPTGLQPPGCKDHGCSSGSPFRDPAGSSVIRSGKGDRPEGPSFLRPPAVTVKKLQKWMYKGRLLSLGMKGRARGTAPKVTGTQAASPNVGALKVRENRVLSVPPDQRITLTGRILCDENASTASLTVYRLGFCLKSQEKVMFLLTDLFENAYGSSMKGRELEELKDNIEFRGHKPLNSITVSKKRNWLYQSTLRPLNLEEENKKCQDRSHLSISPVSLPKHQLSQSFLKSSKEYCTYVVCNATNSSLSKNCALDFNEENDADDEGEIWYNPIPEDDDLGISSALSFGEADSAVLKLPAVNLSMLSGSDLMKAERHTEDSLCSSEHAGDIQTTRSNGMNPIHPAHSTEFVQQYKQKLGHKTQEGIMVEDSPMLKSPFAGKNDHICVFLSSSIFELFDNS

SEQ ID NO: 845000 - protein, 115 aa, Homo sapiens
LQVSPQVSSRAWEKQSAVPQPGLLRSSVERIYSDYNNQVLQKRCDEESEQQRFEGNKTLSTKVLLLVFSLVPIRASLEVKRADTVAEWLVGESLRDYPRNSVAARGGAASQKMEF

SEQ ID NO: 845001 - protein, 118 aa, Homo sapiens
LQVSPQVSSRAWEKQSAVPQPGLLRSSVERIYSDYNNQVLQKRCDEESEQQRFEGNKTLSTKVLLLVFSLVPIRASLEVKRADTVAEWLVGESLRDYPRNSVAARGGAASQEIFRDAR

SEQ ID NO: 845002 - protein, 131 aa, Homo sapiens
PGSHSAVVGKQGVSEGNLGTLLPSPFKDVLGWNKERWRVGCLAQPPWLLVLLSSAGSSGKAWAWGGGLGAVFSCGVVGSFVFQDGPVGSVWGRKELGAWAACVSAGCCQHRHGPSNFSEPDAGDAEVNPET

SEQ ID NO: 845003 - protein, 131 aa, Homo sapiens; identical to SEQ ID NO: 845002

SEQ ID NO: 845004 - protein, 101 aa, Homo sapiens
LKGPISKNSHIAGYCFNICIWGRGHHSVLNRVVTANMESQSLLPFRIPAPTQGWGGGAERYGKQTRRVAGTMLGWLRSASEDIWNWQGSVQGGGGPGRAVS

SEQ ID NO: 845005 - protein, 175 aa, Homo sapiens
PGSHSAVVGKQGVSEGNLGTLLPSPFKDVLGWNKERWRVGCLAQPPWLLVLLSSAGSSGKAWAWGGGLGAVFSCGVVGSFVFQDGPVGSVWGRKELGAWAACVSAGCCQVAPSGPHLQDSWPGLLFGPRVTLDSGHSDLAVRLRWFSSPLGDSLKISSSSHLLGWSLPWIGTLPG

SEQ ID NO: 845006 - protein, 131 aa, Homo sapiens; identical to SEQ ID NO: 845002

SEQ ID NO: 845007 - protein, 68 aa, Homo sapiens
RSQLDYEVPREKAFQKSSTGFSPETSFLDSQVMTALKMERYLKKIHFLYLNVAPSRYFRDGVLPHWPS

SEQ ID NO: 845008 - protein, 221 aa, Homo sapiens
MSETAPLAPTIPAPAEKTPVKKKAKKAGATAGKRKASGPPVSELITKAVAASKERSGVSLAALKKALAAAGYDVEKNNSRIKLGLKSLVSKGTLVQTKGTGASGSFKLNKKAASGEGKPKAKKAGAAKPRKPAGAAKKPKKVAGAATPKKSIKKTPKKVKKPATAAGTKKVAKSAKKVKTPQPKKAAKSPAKAKAPKPKAAKPKSGKPKVTKAKKAAPKKK

SEQ ID NO: 845009 - protein, 425 aa, Homo sapiens
AAASPAPSEEAGCGGERRLRGHGRASVALGRAHRPQPERWWQPPQKAFPGGGGGGPWSSAAGMSGSCAAPGPGSGSSPAACRFAHYFVLCGIDADSGLEPDELAGENFDQSPLRRTFKSKVLAHYPQNIEWNPFDQDAVNMIINALMTVAEGITTLLFPFQWQHVYVPILPASLLHFLDAPVPYLMGLQSKEGTDRSKLELPQEANLCFVDIDNHFIELPEEFPQFPNKVDFIQELSEVLVQFGIPPEGSLHCSESTSKLKNMVLKDLVNDKKNGNVCTNNISMYELLKGNETIARLQALAKRTGVAVEKMDLSASLGEKDKDLKLHCEEAELRDYQLNVQLREVFANRFTQMFADYEAFVIQTAQDMESWLTNREQMQNFDKVKRTIVFLLWLLVALLLILTFLNFLFFCAYAYPYIIDFVNLF

SEQ ID NO: 845010 - protein, 363 aa, Homo sapiens
AAASPAPSEEAGCGGERRLRGHGRASVALGRAHRPQPERWWQPPQKAFPGGGGGGPWSSAAGMSGSCAAPGPGSGSSPAACRFAHYFVLCGIDADSGLEPDELAGENFDQSPLRRTFKSKVLAHYPQNIEWNPFDQDAVNMLCMPKGLSFRTQTDNKDPQFHSFIITREDGSRTYGFVLTFYEEVTSKQICTAMQTLYQMHNAEQYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQ

SEQ ID NO: 845011 - protein, 385 aa, Homo sapiens
AAASPAPSEEAGCGGERRLRGHGRASVALGRAHRPQPERWWQPPQKAFPGGGGGGPWSSAAGMSGSCAAPGPGSGSSPAACRFAHYFVLCGIDADSGLEPDELAVWYNGLEADRHGKSQGAANTTSGENFDQSPLRRTFKSKVLAHYPQNIEWNPFDQDAVNMLCMPKGLSFRTQTDNKDPQFHSFIITREDGSRTYGFVLTFYEEVTSKQICTAMQTLYQMHNAEQYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQ

SEQ ID NO: 845012 - protein, 172 aa, Homo sapiens
SAEPYAILRRSAEQYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQ

SEQ ID NO: 845013 - protein, 457 aa, Homo sapiens
AAASPAPSEEAGCGGERRLRGHGRASVALGRAHRPQPERWWQPPQKAFPGGGGGGPWSSAAGMSGSCAAPGPGSGSSPAACRFAHYFVLCGIDADSGLEPDELAGENFDQSPLRRTFKSKVLAHYPQNIEWNPFDQDAVNMIINALMTVAEGITTLLFPFQWQHVYVPILPASLLHFLDAPVPYLMGLQSKEGTDRSKLELPQEANLCFVDIDNHFIELPEEFPQFPNKVDFIQELSEVLVQFGIPPEGSLHCSESTSKLKNMVLKDLVNDKKNGNVCTNNISMYELLKGNETIARLQALAKRTGVAVEKMDLSASLGEKDKDLKLHCEEAELRDYQLNVQLREVFANRFTQMFADYEAFVIQTAQDMESWLTNREQMQNFDKASFLSDQPEPYLPFLSRFIETQMFATFIDNKIMSQWEEKDPLLRVFDTRIDKIRLYNVRAPTLRTSIYQKCSTL

SEQ ID NO: 845014 - protein, 171 aa, Homo sapiens
RSISDTHAAAAEQYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQ

SEQ ID NO: 845015 - protein, 262 aa, Homo sapiens
VRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPAGTGPAGTAAIAQRLGPQREGEISQMLIVNEELQARLARAARDRAAQSQGPAPRNRSSA

SEQ ID NO: 845016 - protein, 137 aa, Homo sapiens
RGCRGPEDPPSPLHSHRDLEPESEPQLESETAGKWVLCNYDFQARNSSELSVKQRDVLEVLDDSRKWWKVRDPAGQEGYVPPPSRFPGSRLLGMRLCVSLPASPTFSLHSFLRPGPAPLQTLPSVQPLRFAPAVSAG

SEQ ID NO: 845017 - protein, 123 aa, Homo sapiens
LVLEVSIAYEFGGGTETYERSQHEARTSEVPRHCYETPHVPLVDAAGPSMHTSRLRVTLDEPPLPAGSMLQLSHAVDENEGYDHCVGGVCVAIAGITCGIVERLSVGKKTHSEVTPIYVKLSP

SEQ ID NO: 845018 - protein, 138 aa, Homo sapiens
GQLQQKKMKRDLHQMRSRLAQERSVKLDALQRAEELQGQLHDAQRSAVPMGSSGDLISQAQYSPTSASTSSRYSQQRFLKTNLKGSKITRWIQRPQTVPIKHKKRTDDVFLPNMAENVQLTAFQVQTAPSRFPFRADW

SEQ ID NO: 845019 - protein, 121 aa, Homo sapiens
GPTAAEKNEEGPPPDEKPACPGAQCEAGCSPACRGAAGSTSRCPAVSCPHGLVRRYSQQRFLKTNLKGSKITRWIQRPQTVPIKHKKRTDDVFLPNMAENVQLTAFQVQTAPSRFPFRADW

SEQ ID NO: 845020 - protein, 138 aa, Homo sapiens; identical to SEQ ID NO: 845018

SEQ ID NO: 845021 - protein, 40 aa, Homo sapiens
MCQGWWLMPVIPALCKATVGRYLSPGVGDQPGPHGKTCSL

SEQ ID NO: 845022 - protein, 100 aa, Homo sapiens
ESTQRPAGFRNRYAMIRFQLGPAAFKSHKQRPCGIVRRKGLVWQELVYNIFANLKLLHTMTSHLGGLGGRHLPLPPRVCGLDSLNCPFPYRVSSFGLLYF

SEQ ID NO: 845023 - protein, 158 aa, Homo sapiens [sequence omitted]

SEQ ID NO: 845024 - protein, 158 aa, Homo sapiens [sequence omitted]

SEQ ID NO: 845025 - protein, 158 aa, Homo sapiens [sequence omitted]

SEQ ID NO: 845026 - protein, 158 aa, Homo sapiens [sequence omitted]

SEQ ID NO: 845027 - protein, 158 aa, Homo sapiens [sequence omitted]

SEQ ID NO: 845028 - protein, 158 aa, Homo sapiens [sequence omitted]

SEQ ID NO: 845029 - protein, 158 aa, Homo sapiens [sequence omitted]

SEQ ID NO: 845030 - protein, 130 aa, Homo sapiens
MSGIALSRLAQERKAWRKDHPFTPWEGGLFKLRMLFKDDYPSSPPKCKFEPPLFHPNVYPSGTVCLSILEEDKDWRPAITIKQILLGIQELLNEPNIQDPAQAEAYTIYCQNRVEYEKRVRAQAKKFAPS

SEQ ID NO: 845031 - protein, 110 aa, Homo sapiens [sequence omitted]

SEQ ID NO: 845032 - protein, 110 aa, Homo sapiens [sequence omitted]

SEQ ID NO: 845033 - protein, 126 aa, Homo sapiens
IPQQRAHACSHSGQPRSCWCRPCAPAVWDGRGVGRSAVVSSRSPGSVPCASPWYLKSRKLPADVAVGITGQMQWSVGASVRGSCRCSWRVGFLVIPPAALDMPHCVSFRSIEREEGGCPGKRWEIA

SEQ ID NO: 845034 - protein, 91 aa, Homo sapiens
ARATGSARRRGRRSGPGGRSGARGRRAEGSPALGPAPRAPPAPGSSELLWLRAERAPEGSPETKGSAAAAAPLGPPPVRYARRGCGRPRLP

SEQ ID NO: 845035 - protein, 150 aa, Homo sapiens
ARATGSARRRGRRSGPGGRSGARGRRAEGSPALGPAPRAPPAPGSSELLWLRAERAPEGSPETKGSAAAAAPLGPPPVRYARRGCGRPRDFEHVGDRPQQTRPGEESMEERPPIWFRGCPNKKSRWHDEPHELGVRHSRKERDSVGRRLV

SEQ ID NO: 845036 - protein, 158 aa, Homo sapiens [sequence omitted]

SEQ ID NO: 845037 - protein, 110 aa, Homo sapiens
WGEGTGVLLALPAPVCGTRCPPAQPPTPVSSSPFQEGLSDSLSGHGRGPDRPLGGAGPGFRLVWEPPLSGLWPPVSSQSWRLCPRSDPLPPGPACGRQAAHLTTVYFPTG

SEQ ID NO: 845038 - protein, 185 aa, Homo sapiens
MARAPPRSVLHLSATLAGAAAARGTLNMSGIALSRLAQERKAWRKDHPFGFVAVPTKNPDGTMNLMNWECAIPGKKGTPWEGGLFKLRMLFKDDYPSSPPKCKFEPPLFHPNVYPSGTVCLSILEEDKDWRPAITIKQILLGIQELLNEPNIQDPAQAEAYTIYCQNRVEYEKRVRAQAKKFAPS

SEQ ID NO: 845039 - protein, 158 aa, Homo sapiens [sequence omitted]

SEQ ID NO: 845040 - protein, 158 aa, Homo sapiens [sequence omitted]

SEQ ID NO: 845041 - protein, 158 aa, Homo sapiens [sequence omitted]

SEQ ID NO: 845042 - protein, 198 aa, Homo sapiens
SVTVLRRFRGSLGLSGLWPPAPGPDPKETSGTCGWRGTLNMSGIALSRLAQERKAWRKDHPFGFVAVPTKNPDGTMNLMNWECAIPGKKGTPWEGGLFKLRMLFKDDYPSSPPKCKFEPPLFHPNVYPSGTVCLSILEEDKDWRPAITIKQILLGIQELLNEPNIQDPAQAEAYTIYCQNRVEYEKRVRAQAKKFAPS

SEQ ID NO: 845043 - protein, 158 aa, Homo sapiens [sequence omitted]

SEQ ID NO: 845044 - protein, 345 aa, Homo sapiens
MARAPPRSVLHLSATLAGAAAARGERVRGPGRGRGAGVGPRPLLLLGPGPRLPRAPPRRAGPRAAAELSGEPERPRARRRLGPRCWRRWAAARAAGPPQAFGAGAPPLRPRGAPGAGPGQPPAAGAPRGRAFLLRGERLPGSRSPRGRIGWAAGGESWIATSLARGGGGRRAGLFSVPENQNKWTLNMSGIALSRLAQERKAWRKDHPFGFVAVPTKNPDGTMNLMNWECAIPGKKGTPWEGGLFKLRMLFKDDYPSSPPKCKFEPPLFHPNVYPSGTVCLSILEEDKDWRPAITIKQILLGIQELLNEPNIQDPAQAEAYTIYCQNRVEYEKRVRAQAKKFAPS

SEQ ID NO: 845045 - protein, 173 aa, Homo sapiens
GTEAVLCLLCSRTLNMSGIALSRLAQERKAWRKDHPFGFVAVPTKNPDGTMNLMNWECAIPGKKGTPWEGGLFKLRMLFKDDYPSSPPKCKFEPPLFHPNVYPSGTVCLSILEEDKDWRPAITIKQILLGIQELLNEPNIQDPAQAEAYTIYCQNRVEYEKRVRAQAKKFAPS

SEQ ID NO: 845046 - protein, 224 aa, Homo sapiens
AGNGERSAAREALGAGRQERRARQACRGQPRVRPRPARPARARVLGAALAARGAGSGGKSRDKGKRRRRRPARSSTCPLRSPGLRPPEGFVAVPTKNPDGTMNLMNWECAIPGKKGTPWEGGLFKLRMLFKDDYPSSPPKCKFEPPLFHPNVYPSGTVCLSILEEDKDWRPAITIKQILLGIQELLNEPNIQDPAQAEAYTIYCQNRVEYEKRVRAQAKKFAPS

SEQ ID NO: 845047 - protein, 199 aa, Homo sapiens
GTEAVLCLLCSRTLNMSGIALSRLAQERKAWRKDHPFGFVAVPTKNPDGTMNLMNWECAIPGKKGTPWEGGLFKLRMLFKDDYPSSPPKCKFEPPLFHPNVYPSGTVCLSILEEDKDWRPAITIKQILLGIQELLNEPNIQDPAQAEAYTIYWLVAALAPLVAAPPRPSQGRLAGREWSTQAHPRDSQGPRLCGEGRGA

SEQ ID NO: 845048 - protein, 167 aa, Homo sapiens
MGSEHGESSSRSWACHVGVEGGGTCGVSESSPVRDSLETVVGGRSTPLWARTLPDPSCAPHFLPVWPLLPAPSLRGGHGEGQTVQRAGGLRAPLHHVRRAWGRTSWWGPIWGCLQPGPACLGLSRGPGGQCPAGPCHPLAVTPAPADWRTQVPSPAFSQAALRICVW

SEQ ID NO: 845049 - protein, 141 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKMIPTPPDRYS

SEQ ID NO: 845050 - protein, 1122 aa, Homo sapiens
QWWRWRRHHTKPSGNIQNVPRTSRQGGAQPGCKHASKEAVPTPQNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 845051 - protein, 539 aa, Homo sapiens
MLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 845052 - protein, 475 aa, Homo sapiens
TASTSLGVESAEDKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 845053 - protein, 1114 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 845054 - protein, 379 aa, Homo sapiens [sequence omitted]

SEQ ID NO: 845055 - protein, 1114 aa, Homo sapiens; identical to SEQ ID NO: 845053

SEQ ID NO: 845056 - protein, 172 aa, Homo sapiens
LLVPVRIPGMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWPQKVQNFYLVPSKKRDQCLRFRPPLP

SEQ ID NO: 845057 - protein, 1072 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSGKDL

SEQ ID NO: 845058 - protein, 1015 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTISAGATVTRSPSAPAPWPGFTCTCGFSGVLSCTQP

SEQ ID NO: 845059 - protein, 878 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVKSLSTSVLGHPHTDTLALQKIVLHNTFGFKFNLT

SEQ ID NO: 845060 - protein, 844 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVV

SEQ ID NO: 845061 - protein, 505 aa, Homo sapiens
LYCVMADLEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTGN

SEQ ID NO: 845062 - protein, 353 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQVSVCT

SEQ ID NO: 845063 - protein, 1114 aa, Homo sapiens; identical to SEQ ID NO: 845053

SEQ ID NO: 845064 - protein, 924 aa, Homo sapiens
LYCVMSCSRGYRRCTMARPPGPRRPLCLRAAPALLPDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 845065 - protein, 1114 aa, Homo sapiens; identical to SEQ ID NO: 845053

SEQ ID NO: 845066 - protein, 1114 aa, Homo sapiens; identical to SEQ ID NO: 845053

SEQ ID NO: 845067 - protein, 1114 aa, Homo sapiens; identical to SEQ ID NO: 845053

SEQ ID NO: 845068 - protein, 1076 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYESWSHSKQMESFSTHASIWPRHLHMHIAAFIMGCIITCKHQEHMNHTYSWEPFHAIITIIELSSEGSH

SEQ ID NO: 845069 - protein, 1021 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERSTFWEPFCYPY

SEQ ID NO: 845070 - protein, 803 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKQKTNQHHTNFLGRLGPEKVLYHTLWGPGPRVG

SEQ ID NO: 845071 - protein, 682 aa, Homo sapiens
VLRHELIYEDTEDARWRVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQPLSYSSPL

SEQ ID NO: 845072 - protein, 258 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLRRMDDICQILILD

SEQ ID NO: 845073 - protein, 744 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHNAKIIKYIRTKTKPHLFYIPGRMCPATQKLIEESQRKMNALFEGRRIEFAEQINKMEARPRRQSMKEKEHQVVRNEEQKAEQEEGKVAQREEELEETGNQHNDVEIEEAGEEEEKEIAIVHSDAEKEQEEEEQKQEMEVKMEEETEVRESEKQQDSQPEEVMDVLEMVENVKHVIADQEVMETNRVESVEPSENEASKELEPEMEFEIEPDKECKSLSPGKENVSALDMEKESEEKEEKESEPQPEPVAQPQPQSQPQLQLQSQSQPVLQSQPPSQPEDLSLAVLQPTPQVTQEQGHLLPERKDFPVESVKLTEVPVEPVLTVHPESKSKTKTRSRSRGRARNKTSKSRSRSSSSSSSSSSSTSSSSGSSSSSGSSSSRSSSSSSSSTSGSSSRDSSSSTSSSSESRSRSRGRGHNRDRKHRRSVDRKRRDTSGLERSHKSSKGGSSRDTKGSKDKNSRSDRKRSISESSRSGKRSSRSERDRKSDRKDKRR

SEQ ID NO: 845074 - protein, 744 aa, Homo sapiens; identical to SEQ ID NO: 845073

SEQ ID NO: 845075 - protein, 744 aa, Homo sapiens; identical to SEQ ID NO: 845073

SEQ ID NO: 845076 - protein, 744 aa, Homo sapiens; identical to SEQ ID NO: 845073

SEQ ID NO: 845077 - protein, 184 aa, Homo sapiens
CTSGSSSRDSSSSTSSGSEGRKVVGKVVGRGRARNKTSKSRSRSSSSSSSSSSSTSSSSGSSSSSGSSSSRSSSSSSSSTSGSSSRDSSSSTSSSSESRSRSRGRGHNRDRKHRRSVDRKRRDTSGLERSHKSSKGGSSRDTKGSKDKNSRSDRKRSISESSRSGKRSSRSERDRKSDRKDKRR

SEQ ID NO: 845078 - protein, 744 aa, Homo sapiens; identical to SEQ ID NO: 845073

SEQ ID NO: 845079 - protein, 120 aa, Homo sapiens
KHQLRTRKYSSSSRSHMGAYSRDSSSSTSSSSESRSRSRGRGHNRDRKHRRSVDRKRRDTSGLERSHKSSKGGSSRDTKGSKDKNSRSDRKRSISESSRSGKRSSRSERDRKSDRKDKRR

SEQ ID NO: 845080 - protein, 609 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHNAKIIKYIRTKTKPHLFYIPGRMCPATQKLIEESQRKMNALFEGRRIEFAEQINKMEARPRRQSMKEKEHQVVRNEEQKAEQEEGKVAQREEELEETGNQHNDVEIEEAGEEEEKEIAIVHSDAEKEQEEEEQKQEMEVKMEEETEVRESEKQQDSQPEEVMDVLEMVENVKHVIADQEVMETNRVESVEPSENEASKELEPEMEFEIEPDKECKSLSPGKENVSALDMEKESEEKEEKESEPQPEPVAQPQPQSQPQLQLQSQSQPVLQSQPPSQPEDLSLAVLQPTPQVTQEQGHLLPERKDFPVESVKLTEVPVEPVLTVHPESKSKTKTRSRSAWVQKCAWVQKCAWVQKCAG

SEQ ID NO: 845081 - protein, 268 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHNRRSRDGTELDSLPSS

SEQ ID NO: 845082 - protein, 277 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHKCHNSLCRWKQGWASPTSLNLKNMG

SEQ ID NO: 845083 - protein, 234 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVAAFGTESELAQWQEDGMYA

SEQ ID NO: 845084 - protein, 188 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKKLSQ

SEQ ID NO: 845085 - protein, 97 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRLRWRRKLR

SEQ ID NO: 845086 - protein, 744 aa, Homo sapiens; identical to SEQ ID NO: 845073

SEQ ID NO: 845087 - protein, 584 aa, Homo sapiens
MDEKGKQRNRRIFGLLMGTLQKFKQESTVATERQKRRQEIEQKLEVQAEEERKQVENERRELFEERRAKQTELRLLEQKVELAQLQEEWNEHNAKIIKYIRTKTKPHLFYIPGRMCPATQKLIEESQRKMNALFEGRRIEFAEQINKMEARPRRQSMKEKEHQVVRNEEQKAEQEEGKVAQREEELEETGNQHNDVEIEEAGEEEEKEIAIVHSDAEKEQEEEEQKQEMEVKMEEETEVRESEKQQDSQPEEVMDVLEMVENVKHVIADQEVMETNRVESVEPSENEASKELEPEMEFEIEPDKECKSLSPGKENVSALDMEKESEEKEEKESEPQPEPVAQPQPQSQPQLQLQSQSQPVLQSQPPSQPEDLSLAVLQPTPQVTQEQGHLLPERKDFPVESVKLTEVPVEPVLTVHPESKSKTKTRSRSRGRARNKTSKSRSRSSSSSSSSSSSTSSSSGSSSSSGSSSSRSSSSSSSSTSGSSSRDSSSSTSSSSESRSRSRGRGHNRDRKHRRSVDRKRRDTSGLERSHKSSKGGSSRDTKGSKDKNSRSDRKRSISESSRSGKRSSRSERDRKSDRKDKRR

SEQ ID NO: 845088 - protein, 725 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHNAKIIKYIRTKTKPHLFYIPGRMCPATQKLIEESQRKMNALFEGRRIEFAEQINKMEARPRRQSMKEKEHQVVRNEEQKAEQEEGKVAQREEELEETGNQHNDVEIEEAGEEEEKEIAIVHSDAEKEQEEEEQKQEMEVKMEEETEVRESEKQQDSQPEEVMDVLEMVENVKHVIADQEVMETNRVESVEPSENEASKELEPEMEFEIEPDKECKSLSPGKENVSALDMEKESEEKEPQLQLQSQSQPVLQSQPPSQPEDLSLAVLQPTPQVTQEQGHLLPERKDFPVESVKLTEVPVEPVLTVHPESKSKTKTRSRSRGRARNKTSKSRSRSSSSSSSSSSSTSSSSGSSSSSGSSSSRSSSSSSSSTSGSSSRDSSSSTSSSSESRSRSRGRGHNRDRKHRRSVDRKRRDTSGLERSHKSSKGGSSRDTKGSKDKNSRSDRKRSISESSRSGKRSSRSERDRKSDRKDKRR

SEQ ID NO: 845089 - protein, 744 aa, Homo sapiens; identical to SEQ ID NO: 845073

SEQ ID NO: 845090 - protein, 744 aa, Homo sapiens; identical to SEQ ID NO: 845073

SEQ ID NO: 845091 - protein, 674 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHNAKIIKYIRTKTKPHLFYIPGRMCPATQKLIEESQRKMNALFEGRRIEFAEQINKMEARPRRQSMKEKEHQVVRNEEQKAEQEEGKVAQREEELEETGNQHNDVEIEEAGEEEEKEIAIVHSDAEKEQEEEEQKQEMEVKMEEETEVRESEKQQDSQPEEVMDVLEMVENVKHVIADQEVMETNRVESVEPSENEASKELEPEMEFEIEPDKECKSLSPGKENVSALDMEKESEEKEEKESEPQPEPVAQPQPQSQPQLQLQSQSQPVLQSQPPSQPEDLSLAVLQPTPQVTQEQGHLLPERKDFPVESVKLTEVPVEPVLTVHPESKSKTKTRSRSRGRARNKTSKSRSRSSSSSSSSSMEVVAVAVVPVAAPVQVAAAAEIVAVALVVVVRVEVGVGAGDIIEIESTEGAWIGREGILQD

SEQ ID NO: 845092 - protein, 350 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHNAKIIKYIRTKTKPHLFYIPGRMCPATQKLIEESQRKMNAKAAPGNEQKLEVQAEEERKQVENERRELFEERRAKQTELRLLEQKVELAQWQEDGMYA

SEQ ID NO: 845093 - protein, 301 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHNRRSRDIFVTGDYFGNYLVDAASDHNGCHYYEDDYIMQWAVYDYVVDLD

SEQ ID NO: 845094 - protein, 215 aa, Homo sapiens
CQSFRASAARHSPARPVKQSQACRREKMAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERVFIQVLFCIIYLSYQSSRLMFF

SEQ ID NO: 845095 - protein, 203 aa, Homo sapiens
AAAPTSEWYQDQNMDEKGKQRNRRIFGLLMGTLQKFKQESTVATERQKRRQEIEQKLEVQAEEERKQVENERRELFEERRAKQTELRLLEQKVELAQLQEEWNEHNAKIIKYIRTKTKPHLFYIPGRMCPATQKLIEESQRKMNAKAAPGNEQKLEVQAEEERKQVENERRELFEERRAKQTELRLLEQKVELAQWQEDGMYA

SEQ ID NO: 845096 - protein, 299 aa, Homo sapiens
MAAAEEGCSVGAEADRELEELLESALDDFDKAKPSPAPPSTTTAPDASGPQKRSPGDTAKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMPPGLNFDLDALNLSGPPGASGEQCLIM

SEQ ID NO: 845097 - protein, 299 aa, Homo sapiens; identical to SEQ ID NO: 845096

SEQ ID NO: 845098 - protein, 299 aa, Homo sapiens; identical to SEQ ID NO: 845096

SEQ ID NO: 845099 - protein, 281 aa, Homo sapiens [sequence omitted]

SEQ ID NO: 845100 - protein, 284 aa, Homo sapiens
MAAAEEGCSVGAEADRELEELLESALDDFDKAKPSPAPPSTTTAPDASGPQKRSPGDTAKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQPPGLNFDLDALNLSGPPGASGEQCLIM

SEQ ID NO: 845101 - protein, 273 aa, Homo sapiens
PASYGKSEVARWPPLRKAVVSGPKRTGNWRSFWKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMPPGLNFDLDALNLSGPPGASGEQCLIM

SEQ ID NO: 845102 - protein, 299 aa, Homo sapiens; identical to SEQ ID NO: 845096

SEQ ID NO: 845103 - protein, 299 aa, Homo sapiens; identical to SEQ ID NO: 845096

SEQ ID NO: 845104 - protein, 118 aa, Homo sapiens
MAAAEEGCSVGAEADRELEELLESALDDFDKAKPSPAPPSTTTAPDASGPQKRSPGDTAKDALFASQEKFFQELFDSELASQATAEFEKAMKELAEEEPHLVEQFQFTSCLKALRITP

SEQ ID NO: 845105 - protein, 299 aa, Homo sapiens; identical to SEQ ID NO: 845096

SEQ ID NO: 845106 - protein, 300 aa, Homo sapiens
THASPTRRCSVGAEADRELEELLESALDDFDKAKPSPAPPSTTTAPDASGPQKRSPGDTAKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMPPGLNFDLDALNLSGPPGASGEQCLIM

SEQ ID NO: 845107 - protein, 279 aa, Homo sapiens [sequence omitted]

SEQ ID NO: 845108 - protein, 299 aa, Homo sapiens; identical to SEQ ID NO: 845096

SEQ ID NO: 845109 - protein, 299 aa, Homo sapiens; identical to SEQ ID NO: 845096

SEQ ID NO: 845110 - protein, 106 aa, Homo sapiens
PQPGRVHRRVPSPLPPPPSASISLQLPSLACGRPVLLPSPVQPGTRVRLAQVSVRDWEATEGRESGTLLELKLPTLSSLNNYRAGLGGTDSIFRSLMGCWVDGAGK

SEQ ID NO: 845111 - protein, 106 aa, Homo sapiens; identical to SEQ ID NO: 845110

SEQ ID NO: 845112 - protein, 106 aa, Homo sapiens; identical to SEQ ID NO: 845110

SEQ ID NO: 845113 - protein, 89 aa, Homo sapiens [sequence omitted]

SEQ ID NO: 845114 - protein, 482 aa, Homo sapiens
GVPVWLRDTSKLQSALWLWTPGRTMPSLVWVIQTHVGCRGQVEPSCRFCYLTVITESRKRIGNAGSLIKAEWQERGIWRLPPCLHSPSCRPGRMSDEETLSSSNTQGEVLQHQKLSANAPATAYRNCCRLESTSLPRHCTSVGNQVIAVVMDLFTDGDIFQDIVDAACKRRVPVYIILDEAGVKYFLEMCQDLQLTDFRIRNIRVRSVTGVGFYMPMGRIKGTLSSRFLMVDGDKVATGSYRFTWSSSHVDRNLLLLLTGQNVEPFDTEFRELYAISEEVDLYRQLSLAGRVGLHYSSTVARKLINPKYALVSGCRHPPGEMMRWAARQQREAGGNPEGQEEGASGGESAWRLESFLKDLVTVEQVLPPVEPIPLGELSQKDGRMVSHMHRDLKPKSREAPSRNGMGEAARGEAAPARRFSSRLFSRRAKRPAAPNGMASSVSTETSEVEFLTGKRPNENSSADISGKTSPSSAKPSNCVIS

SEQ ID NO: 845115 - protein, 532 aa, Homo sapiens
GEAPRPSAAPGAAVGPRTAAGPGPGRGRGRGAMAESQLNCLDEAHVNEKVTEAQAAFYYCERRRAALEALLGGGEQAYRERLKEEQLRDFLSSPERQALRAAWSPYEDAVPAANARGKSKAKAKAPAPAPAESGESLAYWPDRSDTEVPPLDLGWTDTGFYRGVSRVTLFTHPPKDEKAPHLKQVVRQMIQQAQKVIAVVMDLFTDGDIFQDIVDAACKRRVPVYIILDEAGVKYFLEMCQDLQLTDFRIRNIRVRSVTGVGFYMPMGRIKGTLSSRFLMVDGDKVATGSYRFTWSSSHVDRNLLLLLTGQNVEPFDTEFRELYAISEEVDLYRQLSLAGRVGLHYSSTVARKLINPKYALVSGCRHPPGEMMRWAARQQREAGGNPEGQEEGASGGESAWRLESFLKDLVTVEQVLPPVEPIPLGELSQKDGRMVSHMHRDLKPKSREAPSRNGMGEAARGEAAPARRFSSRLFSRRAKRPAAPNGMASSVSTETSEVEFLTGKRPNENSSADISGKTSPSSAKPSNCVIS

SEQ ID NO: 845116 - protein, 532 aa, Homo sapiens; identical to SEQ ID NO: 845115

SEQ ID NO: 845117 - protein, 125 aa, Homo sapiens [sequence omitted]

SEQ ID NO: 845118 - protein, 980 aa, Homo sapiens
IPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSGKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKDGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKSEALQFYLSIPNISYITALNMCHQFSSVKRMANSSLQEISMYAQVTHQKAEEIYRYIHYVFDIQMLPNDLNQDRLKSDI

SEQ ID NO: 845119 - protein, 943 aa, Homo sapiens
IPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSGKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKDGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKSEALQFYLSIPNISYITALNMCHQFSSVKRMANRYVCCNIFK

SEQ ID NO: 845120 - protein, 739 aa, Homo sapiens
IPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSGKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKVWIKERKNIFRWLPEVFLFLSCVCVLY

SEQ ID NO: 845121 - protein, 1015 aa, Homo sapiens
IPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSGKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKRFGHLALMFPMPSASAKRGAHGPQDLADYFGKESWDGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKSEALQFYLSIPNISYITALNMCHQFSSVKRMANSSLQEISMYAQVTHQKAEEIYRYIHYVFDIQMLPNDLNQDRLKSDI

SEQ ID NO: 845122 - protein, 912 aa, Homo sapiens
IPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSGKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKDGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKTHFKKSPCMHK

SEQ ID NO: 845123 - protein, 963 aa, Homo sapiens
MERREEQPGAAGAGAAPALDFTVENVEKALHQLYYDPNIENKNLAQKWLMQAQVSPQAWHFSWQLLQPDKVPEIQYFGASALHIKISRYWSDIPTDQYESLKAQLFTQITRFASGSKIVLTRLCVALASLALSMMPDAWPCAVADMVRLFQAEDSPVDGQGRCLALLELLTVLPEEFQTSRLPQYRKGLVRTSLAVECGAVFPLLEQLLQQPSSPSCVRQKVLKCFSSWVQLEVPLQDCEALIQAAFAALQDSELFDSSVEAIVNAISQPDAQRYVNTLLKLIPLVLGLQEQLRQAVQNGDMETSHGICRIAVALGENHSRALLDQVEHWQSFLALVNMIMFCTGIPGHYPVNETTSSLTLTFWYTLQDDILSFEAEKQAVYQQVYRPVYFQLVDVLLHKAQFPSDEEYGFWSSDEKEQFRIYRVDISDTLMYVYEMLGAELLSNLYDKLGRLLTSSEEPYSWQHTEALLYGFQSIAETIDVNYSDVVPGLIGLIPRISISNVQLADTVMFTIGALSEWLADHPVMINSVLPLVLHALGNPELSVSSVSTLKKICRECKYDLPPYAANIVAVSQDVLMKQIHKTSQCMWLMQALGFLLSALQVEEILKNLHSLISPYIQQLEKLAEEIPNPSNKLAIVHILGLLSNLFTTLDISHHEDDHEGPELRKLPVPQGPNPVVVVLQQVFQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGPRDHPDIVDSFMQLLAQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 845124 - protein, 963 aa, Homo sapiens; identical to SEQ ID NO: 845123

SEQ ID NO: 845125 - protein, 978 aa, Homo sapiens
MERREEQPGAAGAGAAPALDFTVENVEKDPEWPAPAQSCAVLQALHQLYYDPNIENKNLAQKWLMQAQVSPQAWHFSWQLLQPDKVPEIQYFGASALHIKISRYWSDIPTDQYESLKAQLFTQITRFASGSKIVLTRLCVALASLALSMMPDAWPCAVADMVRLFQAEDSPVDGQGRCLALLELLTVLPEEFQTSRLPQYRKGLVRTSLAVECGAVFPLLEQLLQQPSSPSCVRQKVLKCFSSWVQLEVPLQDCEALIQAAFAALQDSELFDSSVEAIVNAISQPDAQRYVNTLLKLIPLVLGLQEQLRQAVQNGDMETSHGICRIAVALGENHSRALLDQVEHWQSFLALVNMIMFCTGIPGHYPVNETTSSLTLTFWYTLQDDILSFEAEKQAVYQQVYRPVYFQLVDVLLHKAQFPSDEEYGFWSSDEKEQFRIYRVDISDTLMYVYEMLGAELLSNLYDKLGRLLTSSEEPYSWQHTEALLYGFQSIAETIDVNYSDVVPGLIGLIPRISISNVQLADTVMFTIGALSEWLADHPVMINSVLPLVLHALGNPELSVSSVSTLKKICRECKYDLPPYAANIVAVSQDVLMKQIHKTSQCMWLMQALGFLLSALQVEEILKNLHSLISPYIQQLEKLAEEIPNPSNKLAIVHILGLLSNLFTTLDISHHEDDHEGPELRKLPVPQGPNPVVVVLQQVFQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGPRDHPDIVDSFMQLLAQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 845126 - protein, 690 aa, Homo sapiens
MYVNTLLKLIPLVLGLQEQLRQAVQNGDMETSHGICRIAVALGENHSRALLDQVEHWQSFLALVNMIMFCTGIPGHYPVNETTSSLTLTFWYTLQDDILSFEAEKQAVYQQVYRPVYFQLVDVLLHKAQFPSDEEYGFWSSDEKEQFRIYRVDISDTLMYVYEMLGAELLSNLYDKLGRLLTSSEEPYSWQHTEALLYGFQSIAETIDVNYSDVVPGLIGLIPRISISNVQLADTVMFTIGALSEWLADHPVMINSVLPLVLHALGNPELSVSSVSTLKKICRECKYDLPPYAANIVAVSQDVLMKQIHKTSQCMWLMQALGFLLSALQVEEILKNLHSLISPYIQQLEKLAEEIPNPSNKLAIVHILGLLSNLFTTLDISHHEDDHEGPELRKLPVPQGPNPVVVVLQQVFQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGPRDHPDIVDSFMQLLAQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 845127 - protein, 532 aa, Homo sapiens [sequence omitted]

SEQ ID NO: 845128 - protein, 398 aa, Homo sapiens
TRRGSGPPRMCVMKQIHKTSQCMWLMQALGFLLSALQVEEILKNLHSLISPYIQQLEKLAEEIPNPSNKLAIVHILGLLSNLFTTLDISHHEDDHEGPELRKLPVPQGPNPVVVVLQQVFQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGPRDHPDIVDSFMQLLAQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 845129 - protein, 415 aa, Homo sapiens
PKKPSREFPKYLTLPSPIPSPTFLACPQDVLVPPQTSQCMWLMQALGFLLSALQVEEILKNLHSLISPYIQQLEKLAEEIPNPSNKLAIVHILGLLSNLFTTLDISHHEDDHEGPELRKLPVPQGPNPVVVVLQQVFQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGPRDHPDIVDSFMQLLAQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 845130 - protein, 101 aa, Homo sapiens
MYVYEMLGAELLSNLYDKLGRLLTSSEEPYSWQVPPKPDSLSLPRPVTTLLLIQASGTLFPQHTEALLYGFQSIAETIDVNYSDVVPGLIGLIPRISISNV

SEQ ID NO: 845131 - protein, 963 aa, Homo sapiens; identical to SEQ ID NO: 845123

SEQ ID NO: 845132 - protein, 67 aa, Homo sapiens
FRAVPLGRAGLYRAVPSQNWQEWGPELEVPGTGARGSPRLAEVPAPSRPAWLVLSVTGAEAAAVAGL

SEQ ID NO: 845133 - protein, 965 aa, Homo sapiens
MERREEQPGAAGAGAAPALDFTVENVEKALHQLYYDPNIENKNLAQKWLMQAQVSPQAWHFSWQLLQPDKVPEIQYFGASALHIKISRYWSDIPTDQYESLKAQLFTQITRFASGSKIVLTRLCVALASLALSMMPDAWPCAVADMVRLFQAEDSPVDGQGRCLALLELLTVLPEEFQTSRLPQYRKGLVRTSLAVECGAVFPLLEQLLQQPSSPSCVRQKVLKCFSSWVQLEVPLQDCEALIQAAFAALQDSELFDSSVEAIVNAISQPDAQRYVNTLLKLIPLVLGLQEQLRQAVQNGDMETSHGICRIAVALGENHSRALLDQVEHWQSFLALVNMIMFCTGIPGHYPVNETTSSLTLTFWYTLQDDILSFEAEKQAVYQQVYRPVYFQLVDVLLHKAQFPSDEEYGFWSSDEKEQFRIYRVDISDTLMYVYEMLGAELLSNLYDKLGRLLTSSEEPYSWQHTEALLYGFQSIAETIDVNYSDVVPGLIGLIPRISISNVQLADTVMFTIGALSEWLADHPVMINSVLPLVLHALGNPELSVSSVSTLKKICRECKYDLPPYAANIVAVSQDVLMKQIHKTSQCMWLMQALGFLLSALQVEEILKNLHSLISPYIQQLEKLAEEIPIPPTSGGGRRILGEWKGGWWGGGGVGGVGGWWSVWMGVGGGGLCGEMVWGVGLWGGGIQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGPRDHPDIVDSFMQLLAQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 845134 - protein, 825 aa, Homo sapiens
MERREEQPGAAGAGAAPALDFTVENVEKALHQLYYDPNIENKNLAQKWLMQAQVSPQAWHFSWQLLQPDKVPEIQYFGASALHIKISRYWSDIPTDQYESLKAQLFTQITRFASGSKIVLTRLCVALASLALSMMPDAWPCAVADMVRLFQAEDSPVDGQGRCLALLELLTVLPEEFQTSRLPQYRKGLVRTSLAVECGAVFPLLEQLLQQPSSPSCVRQKVLKCFSSWVQLEVPLQDCEALIQAAFAALQDSELFDSSVEAIVNAISQPDAQRYVNTLLKLIPLVLGLQEQLRQAVQNGDMETSHGICRIAVALGENHSRALLDQVEHWQSFLALVNMIMFCTGIPGHYPVNETTSSLTLTFWYTLQDDILSFEAEKQAVYQQVYRPVYFQLVDVLLHKAQFPSDEEYGFWSSDEKEQFRIYRVDISDTLMYVYEMLGAELLSNLYDKLGRLLTSSEEPYSWQHTEALLYGFQSIAETIDVNYSDVVPGLIGLIPRISISNVQLADTVMFTIGALSEWLADHPVMINSVLPLVLHALGNPELSVSSVSTLKKICRECKYDLPPYAANIVAVSQDVLMKQIHKTSQCMWLMQALGFLLSALQVEEILKNLHSLISPYIQQLEKLAEEIPNPSNKLAIVHILGLLSNLFTTLDISHHEDDHEGPELRKLPVPQGPNPVVVVLQQVFQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGQDHPDMRFLMQFWQSSEAEPNVPCEDGCKWVSGWRGLQSRAQR

SEQ ID NO: 845135 - protein, 447 aa, Homo sapiens
RVKRLPMEPKFCTGLPLELKTLGNPELSVSSVSTLKKICRECKYDLPPYAANIVAVSQDVLMKQIHKTSQCMWLMQALGFLLSALQVEEILKNLHSLISPYIQQLEKLAEEIPNPSNKLAIVHILGLLSNLFTTLDISHHEDDHEGPELRKLPVPQGPNPVVVVLQQVFQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGPRDHPDIVDSFMQLLAQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 845136 - protein, 103 aa, Homo sapiens
GLQGLEQHQPWTSLWRTWRRYEGSGVGTPVTEQKFWGLSLMAELRPGLGARWYGAPRAPGICSLSGQAVLQCPNGLFLSFLTGRSPVDRYSRVLGWSLQGAVT

SEQ ID NO: 845137 - protein, 285 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQV

SEQ ID NO: 845138 - protein, 1001 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGEILSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845139 - protein, 573 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGIRSWDFSALLMKIPSYSPISLSGLPES

SEQ ID NO: 845140 - protein, 1002 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFDKLSYMCSVESRLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845141 - protein, 505 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGRDQLVYFIANIEYWKVCNFIGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTMPDVAHLPLEKLGPCLPLDLSRGSEVTAPVASDSSYRNECPRAEKEDTQMLPNPSSKAIADGRGAPAAAGISKTEKKVKLEDKSSTAFGIRSWDFSALLMKIPSYSPISLSGLPES

SEQ ID NO: 845142 - protein, 422 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSH

SEQ ID NO: 845143 - protein, 636 aa, Homo sapiens
MYLRRLNIEDLFLGPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845144 - protein, 511 aa, Homo sapiens
MLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845145 - protein, 404 aa, Homo sapiens
MFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845146 - protein, 404 aa, Homo sapiens; identical to SEQ ID NO: 845145

SEQ ID NO: 845147 - protein, 1017 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845148 - protein, 938 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKVKLVHFSLLGNYERRTKENFIK

SEQ ID NO: 845149 - protein, 642 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGEKVCVTM

SEQ ID NO: 845150 - protein, 679 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALF

SEQ ID NO: 845151 - protein, 384 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSEHRFLKNSYLSYKIH

SEQ ID NO: 845152 - protein, 150 aa, Homo sapiens
MFCVFPLEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQV

SEQ ID NO: 845153 - protein, 1017 aa, Homo sapiens; identical to SEQ ID NO: 845147

SEQ ID NO: 845154 - protein, 991 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845155 - protein, 852 aa, Homo sapiens
MGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845156 - protein, 856 aa, Homo sapiens
MFCVFPLEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845157 - protein, 595 aa, Homo sapiens
MPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845158 - protein, 1017 aa, Homo sapiens; identical to SEQ ID NO: 845147

SEQ ID NO: 845159 - protein, 497 aa, Homo sapiens
FTSYPTGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845160 - protein, 330 aa, Homo sapiens
MDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 845161 - protein, 573 aa, Homo sapiens; identical to SEQ ID NO: 845139

SEQ ID NO: 845162 - protein, 711 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCAPRVLGRT

SEQ ID NO: 845163 - protein, 512 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGKRKKIKAPISR

SEQ ID NO: 845164 - protein, 160 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVRVFSIPSYPKGYLLER

SEQ ID NO: 845165 - protein, 406 aa, Homo sapiens
MKKKQQHPGGGADPWPHGAPMGGAPPGLGSWKRRVPLLPFLRFSLRDYGFCMATLLVFCLGSLLYQLSGGPPRFLLDLRQYLGNSTYLDDHGPPPSKVLPFPSQVVYNRVGKCGSRTVVLLLRILSEKHGFNLVTSDIHNKTRLTKNEQMELIKNISTAEQPYLFTRHVHFLNFSRFGGDQPVYINIIRDPVNRFLSNYFFRRFGDWRGEQNHMIRTPSMRQEERYLDINECILENYPECSNPRLFYIIPYFCGQHPRCREPGEWALERAKLNVNENFLLVGILEELEDVLLLLERFLPHYFKGVLSIYKDPEHRKLGNMTVTVKKTVPSPEAVQILYQRMRYEYEFYHYVKEQFHLLKRKFGLKSHVSKPPLRPHFFIPTPLETEEPIDDEEQDDEKWLEDIYKR

SEQ ID NO: 845166 - protein, 120 aa, Homo sapiens
VRRPLSYQQGSESELNGVQKEQKAGFEHRKLGNMTVTVKKTVPSPEAVQILYQRMRYEYEFYHYVKEQFHLLKRKFGLKSHVSKPPLRPHFFIPTPLETEEPIDDEEQDDEKWLEDIYKR

SEQ ID NO: 845167 - protein, 230 aa, Homo sapiens
MKKKQQHPGGGADPWPHGAPMGGAPPGLGSWKRRVPLLPFLRFSLRDYGFCMATLLVFCLGSLLYQLSGGPPRFLLDLRQYLGNSTYLDDHGPPPSKVLPFPSQVVYNRVGKCGSRTVVLLLRILSEKHGFNLVTSDIHNKTRLTKNEQMELIKNISTAEQPYLFTRHVHFLNFSRFGGDQPVYINIIRDPVNRFLSNYFFRRFGDWRGEQNHMIRTPSMRQEERYLDQP

SEQ ID NO: 845168 - protein, 1002 aa, Homo sapiens
MIFPVARYALRWLRRPEDRAFSRAAMEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNKSDQAHPPIHPTKYTNNLQGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVLEASRDSSVCPVCQPHPVYRLKLKFKRGSLPPTMPLEFVCCIGGCDDTLREILDLRFSGGPPRASQPSGRLQANQSLNRMDNSQHPQPADSRQTGSSKALAYSTLPPPTAAGESNSVTCNCGQEAVLLTVRKEGPNRGRQFFKCNGGSCNFFLWADSPNPGAGGPPALAYRPLGASLGCPPGPGIHLGGFGNPGDGSGSGTSCLCSQPSVTRTVQKDGPNKGRQFHTCAKPREQQCGFFQWVDENTAPGTSGAPSWTGDRGRTLESEARSKRPRASSSDMGSTAKKPRKCSLCHQPGHTRPFCPQNR

SEQ ID NO: 845169 - protein, 114 aa, Homo sapiens
MIFPVARYALRWLRRPEDRAFSRAAMEMALRGVRKVLCVAEKNDAAKGIADLLSNGRMRRREGLSKFNKIYEFDYHLYGQVGAKIFLKYFNHKQEKVVSLVICRICRCLKNNNC

SEQ ID NO: 845170 - protein, 1002 aa, Homo sapiens; identical to SEQ ID NO: 845168

SEQ ID NO: 845171 - protein, 1002 aa, Homo sapiens; identical to SEQ ID NO: 845168

SEQ ID NO: 845172 - protein, 1002 aa, Homo sapiens; identical to SEQ ID NO: 845168

SEQ ID NO: 845173 - protein, 590 aa, Homo sapiens
MIFPVARYALRWLRRPEDRAFSRAAMEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNKSDQAHPPIHPTKYTNNLQGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGPPRMVAVSRGLVQSQLKPTVCQRKKLPGLLPSPAESPK

SEQ ID NO: 845174 - protein, 105 aa, Homo sapiens
MTPVLIVVLYVTRIHCFSVASDHARVHRVWGTFAKAMGRVSAGWSFALAGLVSLLLLLGMITLGDSTVGTKTPATRTCSTMDIGLFVALKNFTSSSIYNVLPSSS

SEQ ID NO: 845175 - protein, 383 aa, Homo sapiens
MIFPVARYALRWLRRPEDRAFSRAAMEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGVHQAPPNRKPNFFPKKTFKTLDPVV

SEQ ID NO: 845176 - protein, 171 aa, Homo sapiens [sequence omitted]

SEQ ID NO: 845177 - protein, 1002 aa, Homo sapiens; identical to SEQ ID NO: 845168

SEQ ID NO: 845178 - protein, 669 aa, Homo sapiens
MGATLIGTLSAAAMAHPHNSPTVPLEYCNALIRLSPSALAGTTPPARGSLRPTAIHGAGVAHCRHCQGNPECEQSLHLNQFNPPNYHQTKFIGTGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVLEASRDSSVCPVCQPHPVYRLKLKFKRGSLPPTMPLEFVCCIGGCDDTLREILDLRFSGGPPRASQPSGRLQANQSLNRMDNSQHPQPADSRQTGSSKALAYSTLPPPTAAGESNSVTCNCGQEAVLLTVRKEGPNRGRQFFKCNGGSCNFFLWADSPNPGAGGPPALAYRPLGASLGCPPGPGIHLGGFGNPGDGSGSGTSCLCSQPSVTRTVQKDGPNKGRQFHTCAKPREQQCGFFQWVDENTAPGTSGAPSWTGDRGRTLESEARSKRPRASSSDMGSTAKKPRKCSLCHQPGHTRPFCPQNR

SEQ ID NO: 845179 - protein, 1002 aa, Homo sapiens; identical to SEQ ID NO: 845168

SEQ ID NO: 845180 - protein, 696 aa, Homo sapiens
MIFPVARYALRWLRRPEDRAFSRAAMEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNKSDQAHPPIHPTKYTNNLQGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVL

SEQ ID NO: 845181 - protein, 479 aa, Homo sapiens
MDETSPLVSPERAQPPDYTFPSGSGAHFPQVPGGAVRVAAAAGSGPSPPGSPGHDRERQPLLDRARGAAAQGQTQTVAAQAQALAAQAAAAAHAAQAHRERNEFPEDPEFEAVVRQAELAIERCIFPERIYQGSSGSYFVKDPQGRIIAVFKPKNEEPYGHLNPKWTKWLQKLCCPCCFGRDCLVLNQGYLSEAGASLVDQKLELNIVPRTKVVYLASETFNYSAIDRVKSRGKRLALEKVPKVGQRFNRIGLPPKVGSFQLFVEGYKDADYWLRRFEAEPLPENTNRQLLLQFERLVVLDYIIRNTDRGNDNWLIKYDCPMDSSSSRDTDWVVVKEPVIKVAAIDNGLAFPLKHPDSWRAYPFYWAWLPQAKVPFSQEIKDLILPKISDPNFVKDLEEDLYELFKKDPGFDRGQFHKQIAVMRGQILNLTQALKDNKSPLHLVQMPPVIVETARSHQRSSSESYTQSFQSRKPFFSWW

SEQ ID NO: 845182 - protein, 479 aa, Homo sapiens; identical to SEQ ID NO: 845181

SEQ ID NO: 845183 - protein, 479 aa, Homo sapiens; identical to SEQ ID NO: 845181

SEQ ID NO: 845184 - protein, 479 aa, Homo sapiens; identical to SEQ ID NO: 845181

SEQ ID NO: 845185 - protein, 142 aa, Homo sapiens
MVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKILINVYDGPPLYDDVKVQFFSSALSTKK

SEQ ID NO: 845186 - protein, 684 aa, Homo sapiens
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 845187 - protein, 684 aa, Homo sapiens; identical to SEQ ID NO: 845186

SEQ ID NO: 845188 - protein, 528 aa, Homo sapiens
EPLGRTLGRTDEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 845189 - protein, 391 aa, Homo sapiens
MTNRTITSSSLNQHISQLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 845190 - protein, 282 aa, Homo sapiens
WRNCSLNYPALQILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 845191 - protein, 611 aa, Homo sapiens
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKESCFVAQAALKCLGLK

SEQ ID NO: 845192 - protein, 539 aa, Homo sapiens
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 845193 - protein, 137 aa, Homo sapiens
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEGTYLEKTV

SEQ ID NO: 845194 - protein, 684 aa, Homo sapiens; identical to SEQ ID NO: 845186

SEQ ID NO: 845195 - protein, 674 aa, Homo sapiens
MRLQPCSGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 845196 - protein, 688 aa, Homo sapiens
MRMKIEKLAKEQTLGISTFKGGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 845197 - protein, 371 aa, Homo sapiens [sequence omitted]

SEQ ID NO: 845198 - protein, 619 aa, Homo sapiens
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQ

SEQ ID NO: 845199 - protein, 446 aa, Homo sapiens
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIQKQ

SEQ ID NO: 845200 - protein, 98 aa, Homo sapiens
LEKWFDQCSLNTRVTVATKINELDSELELHLHLHQPRAQQIEKDIHNVRAGTDAAWECLPCPQPLLQRLLHRGSMFISCPSLYHAMFSMFSSHHGRCT

SEQ ID NO: 845201 - protein, 102 aa, Homo sapiens
MEVTVSQGTGSSAQPVPFPPSGPQRLWLHVPLAGQNQKWGPSGLPIWGSWRRSLACPPWGAGGQTGCFMESGGVLRQLYLLNAKKPSWFNMIVAAALINQNN

SEQ ID NO: 845202 - protein, 279 aa, Homo sapiens
MKIIILLGFLGATLSAPLIPQRLMSASNSNELLLNLNNGQLLPLQLQGPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 845203 - protein, 197 aa, Homo sapiens
NFTEFNENPVPFSPTTLPPFIYHMKMKIIILLGFLGATLSAPLIPQRLMSASNSNELLLNLNNGQLLPLQLQGPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTYYPRAPRREGQD

SEQ ID NO: 845204 - protein, 265 aa, Homo sapiens
MKIIILLGFLGATLSAPLLLNLNNGQLLPLQLQGPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 845205 - protein, 265 aa, Homo sapiens; identical to SEQ ID NO: 845204

SEQ ID NO: 845206 - protein, 97 aa, Homo sapiens
EKGKGTLSPCGQFTTKVCYAMVCSLLFSRKKSWKNKHLVLGMSGRRKTIQNPISVFERNTDSFILLVWTTVPHADFTELEVVGIMRKSRKSLNHTSL

SEQ ID NO: 845207 - protein, 503 aa, Homo sapiens
WEPLLVPALRPAGEAARRRQRRRQRVLGPQDHGFFPARSIHLAIHPWGSAMATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKRKRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 845208 - protein, 566 aa, Homo sapiens
MGLKCMPSHHHRTGLFTALERQRSFIHSRSQAVRVHAEHPHAHSWWLSLMYLTSHAFPQSSSTVPLHGLGSPKLKCECQSASFKRGLPHGHPLPLCPCFDRSIHLAIHPWGSAMATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKRKRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 845209 - protein, 485 aa, Homo sapiens
WEPLLVPALRPAGEAARRRQRRRQRVLGPQDHGFFPARSIHLAIHPWGSAMATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKRKRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLVRVQPGQPCAQHSLSKMFLLSLSCMCLRVPTFFFWCLSHPHNLSSIRWHPFP

SEQ ID NO: 845210 - protein, 86 aa, Homo sapiens
PGEGTAKTEVWRSDELRSQMDLHISSAPRDLTVSKPLNVELPRSMVEVVTSWNLPMSYWLNNCESPSHHSSCVGNPGPFIHSYNIY

SEQ ID NO: 845211 - protein, 517 aa, Homo sapiens
KKTYGRLRGKRRPLGGWKKSAEGPACEEAARRRQRRRQRVLGPQDHGFFPARSIHLAIHPWGSAMATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKRKRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 845212 - protein, 514 aa, Homo sapiens
WEPLLVPALRPAGEAARRRQRRRQRVLGPQDHGFFPARSIHLAIHPWGSAMATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKRKQETQSQGHHGKRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 845213 - protein, 150 aa, Homo sapiens
KKTYGRLRGKRRPLGGWKKSAEGPACERLPGGGSGGGSASSVPRTTASFLPDLSIWPSIRGGLQWPPLAARNFSSSYCKAVSCLLPSRALTRSGCSLPSASPAASSGGSLHMVWVVLLSLLCYLVLFLCRHSSHRGVFLSVTILIYLLMG

SEQ ID NO: 845214 - protein, 217 aa, Homo sapiens
KSYKCDQYGKNFSQSQDLIVHCKTHSGETPYEFHEWPMGCKQSSDLPRYQKVPSGNKPYKCKECGKGFRCNSFLYNHHGVHTREMPYKCDACGKGFGFRSLLCIHQGVHTGKSPIKVKSVGRALIRAPTFLSIRESTLERSPTNAVSVASALVQAPFFKSTGGFTQGRNLIGVMSVERASAKVHTFTFTRESTQGRNHTNAMCVERILRIALFFTLI

SEQ ID NO: 845215 - protein, 330 aa, Homo sapiens
MTTSLLLHPRWPESLMYVYEDSAAESGIGGGGGGGGGGTGGAGGGCSGASPGKAPSMDGLGSSCPASHCRDLLPHPVLGRPPAPLGAPQGAVYTDIPAPEAARQCAPPPAPPTSSSATLGYGYPFGGSYYGCRLSHNVNLQQKPCAYHPGDKYPEPSGALPGDDLSSRAKEFAFYPSFASSYQAMPGYLDVSVVPGISGHPEPRHDALIPVEGYQHWALSNGWDSQVYCSKEQSQSAHLWKSPFPDVVPLQPEVSSYRRGRKKRVPYTKVQLKELEKEYAASKFITKEKRRRISATTNLSERQVTIWFQNRRVKEKKVVSKSKAPHLHST

SEQ ID NO: 845216 - protein, 330 aa, Homo sapiens; identical to SEQ ID NO: 845215

SEQ ID NO: 845217 - protein, 155 aa, Homo sapiens
MRHLPYFCRGQVVRGFGRGSKQLGIPTANFPEQVVDNLPADISTGIYYGWASVGSGDVHKMVVSIGWNPYYKNTKKSMETHIMHTFKEDFYGEILNVAIVGYLRPEKNFDSLESLISAIQGDIEEAKKRLELPEHLKIKEDNFFQVSKSKIMNGH

SEQ ID NO: 845218 - protein, 155 aa, Homo sapiens; identical to SEQ ID NO: 845217

SEQ ID NO: 845219 - protein, 155 aa, Homo sapiens; identical to SEQ ID NO: 845217

SEQ ID NO: 845220 - protein, 132 aa, Homo sapiens
MGALSNFPEQVVDNLPADISTGIYYGWASVGSGDVHKMVVSIGWNPYYKNTKKSMETHIMHTFKEDFYGEILNVAIVGYLRPEKNFDSLESLISAIQGDIEEAKKRLELPEHLKIKEDNFFQVSKSKIMNGH

SEQ ID NO: 845221 - protein, 168 aa, Homo sapiens
RVRLRKGAHAGGAEAGSALRAAPSPHPAHTRHLLRLSPLPSSGDAAPQAPGGICWVGGVRDSQWPVVGVVRPLVRPRGRQSSRSCPPAGPGSGRRVDGGSAGRADRAAAHAPSGLHYEAPALLLPGSSGAGLRPRLQAAGHPHRKHISCIPSKRTSMGKSSMWPLLAT

SEQ ID NO: 845222 - protein, 155 aa, Homo sapiens; identical to SEQ ID NO: 845217

SEQ ID NO: 845223 - protein, 155 aa, Homo sapiens; identical to SEQ ID NO: 845217

SEQ ID NO: 845224 - protein, 137 aa, Homo sapiens
MRHLPYFCRGQVVRGFGRGSKQLGIPTANFPEQVVDNLPADISTGIYYGWASVGSGDVHKMVVSIGWNPYYKNTKKSMETHIMHTFKEDFYGEILNVAIVGYLRPEKAKKRLELPEHLKIKEDNFFQVSKSKIMNGH

SEQ ID NO: 845225 - protein, 155 aa, Homo sapiens; identical to SEQ ID NO: 845217

SEQ ID NO: 845226 - protein, 84 aa, Homo sapiens
VGSTTDRLKSERVCGRGGRQWREAADQGVKAGPLLSRAGWYLELSTLTQRDLPLDVSPSPAWSARCTCHSYNLGKCAVTASLGE

SEQ ID NO: 845227 - protein, 68 aa, Homo sapiens
GSIKVINFNPSRPREWLGIILQMRHRKYTGSSLQTSDSEQWLGFQSQALAEHSPPTISRDRISLYCSG

SEQ ID NO: 845228 - protein, 548 aa, Homo sapiens
MPLQGSVSFKDVTVDFTQEEWQQLDPAQKALYRDVMLENYCHFVSVGFHMAKPDMIRKLEQGEELWTQRIFPSYSYLEEDGKTEDVLVKFKEYQDRHSRPLIFINHKKLIKERSNIYGKTFTLGKNRITILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRAHRGERTFEYNKDGIAFIEKSSLSVHPSNLMEKKPSAYNKYGKFLCRKPVFIMPQRPQTEEKPFHCPYCGNNFRRKSYLIEHQRIHTGEKPYVCNQCGKAFRQKTALTLHEKTHIEGKPFICIDCGKSFRQKATLTRHHKTHTGEKAYECPQCGSAFRKKSYLIDHQRTHTGEKPYQCNECGKAFIQKTTLTVHQRTHTGEKPYICNECGKSFCQKTTLTLHQRIHTGEKPYICNECGKSFRQKAILTVHHRIHTGEKSNGCPQCGKAFSRKSNLIRHQKTHTGEKPYECKQCGKFFSCKSNLIVHQKTHKVETTGIQ

SEQ ID NO: 845229 - protein, 469 aa, Homo sapiens
MAFLMHLLVCVFGMGSWVTINGLWVELPLLVMELPEGWYLPSYLTVVIQLANIGPLLVTLLHHFRPSCLSEVPIIFTLLGVGTVTCIIFAFLWNMTSWVLDGHHSIAFLVLTFFLALVDCTSSVTFLPFMSRLPTYYLTTFFVGEGLSGLLPALVALAQGSGLTTCVNVTEISDSVPSPVPTRETDIAQGVPRALVSALPGMEAPLSHLESRYLPAHFSPLVFFLLLSIMMACCLVAFFVLQRQPRCWEASVEDLLNDQVTLHSIRLREENDLGPAGMVDSSQGQGYLEEKAAPCCPAHLAFVYTLVAFVNALTNGMLPSVQTYSCLSYGPVAYHLAATLSIVANPLASLVSMFLPNRSLLFLGVLSVLGTCFGGYNMAMAVMSPCPLLQGHWGGEVLIVASWVLFSGCLSYVKVMLGVVLRDLSRSALLWCGAAVQLGSLLGALLMFPLVNVLRLFSSADFCNLHCPA

SEQ ID NO: 845230 - protein, 481 aa, Homo sapiens
MLTPKSQQAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKKVKPAEAETAGAIMAFFLCLGLALGAVFSFLFRAIV

SEQ ID NO: 845231 - protein, 490 aa, Homo sapiens
LQRERADLSAGAVLLRQAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKKVKPAEAETAGAIMAFFLCLGLALGAVFSFLFRAIV

SEQ ID NO: 845232 - protein, 327 aa, Homo sapiens
LQRERADLSAGAVLLRQAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNGCFQP

SEQ ID NO: 845233 - protein, 525 aa, Homo sapiens
AARARGSQRGSSASAAGARGQGPLPEPELGAPPRDCPGLLCSDPSAGQSGHLAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKKVKPAEAETAGAIMAFFLCLGLALGAVFSFLFRAIV

SEQ ID NO: 845234 - protein, 315 aa, Homo sapiens
LQRERADLSAGAVLLRQAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKVSVSNSQPTNESHSIKAILKNGCFQP

SEQ ID NO: 845235 - protein, 426 aa, Homo sapiens
LQRERADLSAGAVLLRQAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWVSGGRGPQAPVGSKSPAWTQRGNPRKYGSKGTICFKVEA

SEQ ID NO: 845236 - protein, 581 aa, Homo sapiens
MLTPKSQQAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINCKLGQEGAYGRRHAQLPPLFFQTSVSQREAQPPPGGSGCCEQLGFRGLSGPGPGLGGGREKGSSASRLTKSKVGMTGICLLGHPQPPALAPLLMPALFAPAFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKKVKPAEAETAGAIMAFFLCLGLALGAVFSFLFRAIV

SEQ ID NO: 845237 - protein, 323 aa, Homo sapiens
IKASTRLVYIGRGIALINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKKVKPAEAETAGAIMAFFLCLGLALGAVFSFLFRAIV

SEQ ID NO: 845238 - protein, 490 aa, Homo sapiens; identical to SEQ ID NO: 845231

SEQ ID NO: 845239 - protein, 455 aa, Homo sapiens
LQRERADLSAGAVLLRQAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKS

SEQ ID NO: 845240 - protein, 116 aa, Homo sapiens
AKLTWVEVETGLQEGVKDNPTIHVPSRRRSQVGVRQPGWVDQQNEVRQSSCSTPPLLPPRGSGLGYSHSEVALPFLPRLGKVKPAEAETAGAIMAFFLCLGLALGAVFSFLFRAIV

SEQ ID NO: 845241 - protein, 528 aa, Homo sapiens
MYEAGCNWPRQRGSSASAAGARGQGPLPEPELGAPPRDCPGLLCSDPSAGQSGHLAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKKVKPAEAETAGAIMAFFLCLGLALGAVFSFLFRAIV

SEQ ID NO: 845242 - protein, 456 aa, Homo sapiens [sequence omitted]

SEQ ID NO: 845243 - protein, 456 aa, Homo sapiens [sequence omitted]

SEQ ID NO: 845244 - protein, 527 aa, Homo sapiens
RAARGAHGRREPEDPAGTGTQAGRGGLAPGPKTGCGHVDLRKGQASGRVIPIDLAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKKVKPAEAETAGAIMAFFLCLGLALGAVFSFLFRAIV

SEQ ID NO: 845245 - protein, 490 aa, Homo sapiens; identical to SEQ ID NO: 845231

SEQ ID NO: 845246 - protein, 490 aa, Homo sapiens; identical to SEQ ID NO: 845231

SEQ ID NO: 845247 - protein, 490 aa, Homo sapiens; identical to SEQ ID NO: 845231

SEQ ID NO: 845248 - protein, 553 aa, Homo sapiens
MLTPKSQQAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINCKLGQEGAYGRRHAQLPPLFFQTSVSQREAQPPPGGSGCCEQLGFRGLSGPGPGLGGGREKGSSASRLTKSETFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKKVKPAEAETAGAIMAFFLCLGLALGAVFSFLFRAIV

SEQ ID NO: 845249 - protein, 490 aa, Homo sapiens; identical to SEQ ID NO: 845231

SEQ ID NO: 845250 - protein, 490 aa, Homo sapiens; identical to SEQ ID NO: 845231

SEQ ID NO: 845251 - protein, 314 aa, Homo sapiens
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYSTILGHQIGLSGREAHEEINITFTLPTAWSSDDCALHGHCEQVVFTACMTLTASPGVFPVTVQPPHCVPDTYSNATLWYKIFTTARDANTKYAQDYNPFWCYKGAIGKVYHALNPKLTVIVPDDDRSLINLHLMHTSYFLFVMVITMFCYAVIKGRPSKLRQSNPEFCPEKVALAEA

SEQ ID NO: 845252 - protein, 314 aa, Homo sapiens; identical to SEQ ID NO: 845251

SEQ ID NO: 845253 - protein, 343 aa, Homo sapiens
SGPYALLALTRLLDLRAAARRGGVELIRIMFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYSTILGHQIGLSGREAHEEINITFTLPTAWSSDDCALHGHCEQVVFTACMTLTASPGVFPVTVQPPHCVPDTYSNATLWYKIFTTARDANTKYAQDYNPFWCYKGAIGKVYHALNPKLTVIVPDDDRSLINLHLMHTSYFLFVMVITMFCYAVIKGRPSKLRQSNPEFCPEKVALAEA

SEQ ID NO: 845254 - protein, 314 aa, Homo sapiens; identical to SEQ ID NO: 845251

SEQ ID NO: 845255 - protein, 203 aa, Homo sapiens
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYSTILGHQIGLSGREAHEEINITFTLPTAWSSDDCALHGHCEQVVFTACMTLTASPGVFPVTVMTVH

SEQ ID NO: 845256 - protein, 314 aa, Homo sapiens; identical to SEQ ID NO: 845251

SEQ ID NO: 845257 - protein, 314 aa, Homo sapiens; identical to SEQ ID NO: 845251

SEQ ID NO: 845258 - protein, 161 aa, Homo sapiens
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYSTILGHQIGLSGKGKAPPKGGFKP

SEQ ID NO: 845259 - protein, 140 aa, Homo sapiens
RVAHASPTRRRAVAGARTEAAAGARLASGLRVGPAEPDAAPGAGRRWCLAASGPPRAATSEPSATAGVRRAAGPAGPGARSCPPGRGGADQNNVQHQPPGEPEGVHQQSASPGGLHDQRKRHGHSFPDPGLLLPTVLIWL

SEQ ID NO: 845260 - protein, 314 aa, Homo sapiens; identical to SEQ ID NO: 845251

SEQ ID NO: 845261 - protein, 286 aa, Homo sapiens [sequence omitted]

SEQ ID NO: 845262 - protein, 148 aa, Homo sapiens
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTYSDSGDTSRDDQQN

SEQ ID NO: 845263 - protein, 445 aa, Homo sapiens
MAEYDLTTRIAHFLDRHLVFPLLEFLSVKEIYNEKELLQGKLDLLSDTNMVDFAMDVYKNLYSDDIPHALREKRTTVVAQLKQLQAETEPIVKMFEDPETTRQMQSTRDGRMLFDYLADKHGFRQEYLDTLYRYAKFQYECGNYSGAAEYLYFFRVLVPATDRNALSSLWGKLASEILMQNWDAAMEDLTRLKETIDNNSVSSPLQSLQQRTWLIHWSLFVFFNHPKGRDNIIDLFLYQPQYLNAIQTMCPHILRYLTTAVITNKDVRKRRQVLKDLVKVIQQESYTYKDPITEFVECLYVNFDFDGAQKKLRECESVLVNDFFLVACLEDFIENARLFIFETFCRIHQCISINMLADKLNMTPEEAERWIVNLIRNARLDAKIDSKLGHVVMGNNAVSPYQQVIEKTKSLSFRSQMLAMNIEKKLNQNSRSEAPNWATQDSGFY

SEQ ID NO: 845264 - protein, 445 aa, Homo sapiens; identical to SEQ ID NO: 845263

SEQ ID NO: 845265 - protein, 445 aa, Homo sapiens; identical to SEQ ID NO: 845263

SEQ ID NO: 845266 - protein, 445 aa, Homo sapiens; identical to SEQ ID NO: 845263

SEQ ID NO: 845267 - protein, 160 aa, Homo sapiens
GQQSTSPCPADEFQWIRVKPTHVPKGWIKGNANDIGMDYDYALLELKKPPQEKIYEDVGVSPPAKQLGGRIHFFGYDNDRPGNLVYRFCDLKDETYDLLYQQCDAQPGASGSGVYVRMWKRQQQKWERNIIDLFLYQPQYLNAIQNNVSTHSSLFDYQQS

SEQ ID NO: 845268 - protein, 108 aa, Homo sapiens
ADTTTKKNAAVCRISINMLADKLNMTPEEAERWIVNLIRNARLDAKIDSKLGHVVMGNNAVSPYQQVIEKTKSLSFRSQMLAMNIEKKLNQNSRSEAPNWATQDSGFY

SEQ ID NO: 845269 - protein, 108 aa, Homo sapiens; identical to SEQ ID NO: 845268

SEQ ID NO: 845270 - protein, 94 aa, Homo sapiens
VGATNKVLVSTDSLFFGKMAEYDLTTRIAHFLDRHLVFPLLEFLSVKGALREKRTTVVAQLKQLQAETEPIVKMFEDPETTRQMQSTRDGRMLL

SEQ ID NO: 845271 - protein, 81 aa, Homo sapiens
PLLRQDGGVRIDYSYRAVGDRHLGLPAVSEWLVCRRSTIKLEGRNCDEVIMDPILELNTKAVVTMCALLRVLYEKPVLCRE

SEQ ID NO: 845272 - protein, 445 aa, Homo sapiens; identical to SEQ ID NO: 845263

SEQ ID NO: 845273 - protein, 445 aa, Homo sapiens; identical to SEQ ID NO: 845263

SEQ ID NO: 845274 - protein, 445 aa, Homo sapiens; identical to SEQ ID NO: 845263

SEQ ID NO: 845275 - protein, 305 aa, Homo sapiens
RAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 845276 - protein, 120 aa, Homo sapiens
VNLYCYQYFIPFYCSLIVHWMNILQFVYPFACTFTCKSLGGPMFLSGINSEIAGLYGNSVRKWKTVSKRFHFTFTPAVSESSTCSESMSTIGIVRLLNCGHSYLCVIWSVCAFNLCLLDY

SEQ ID NO: 845277 - protein, 184 aa, Homo sapiens
MLLPPGSLSRPRTFSSRPPQTKLMTHNGLFRPIPYLTAVSADEATASQQPPQAQLHRYNGLFRPSSCLPAFSLGPELSQVDVTRPSSCFLAASPGPALPPGGLCRPRLSSSRPVQGQLLPPGALCRPKSSSSWPPQAQLQPLGGLSGCKSSSSQPLQAQLLLPPSASFGPAQLMPLGGLPRPRF

SEQ ID NO: 845278 - protein, 106 aa, Homo sapiens
MVSSGGLVCRFPRYIHYRVPSNLGCRMRLWSMTRILVDDERRQSESEGQGQAKLPYSVDAAHVRNLSRRVSSVVYGSRRSRKNSRKGLQFLAGERARSCQESCRLL

SEQ ID NO: 845279 - protein, 214 aa, Homo sapiens
MEVKPPPGRPQPDSGRRRRRRGEEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHLTVKKIFVGGIKEDTEEYNLRDYFEKYGKIETIEVMEDRQSGKKRGFAFVTFDDHDTVDKIVVQKYHITYSPEQFQLRIYTPTNNVQTSNYY

SEQ ID NO: 845280 - protein, 124 aa, Homo sapiens
RSHFRLVTGDGGYNGFGGDGGNYGGGPGYSSRGGYGGGGPGYGNQGGGYGGGGGYDGYNEGGNFGGGNYGGGGNYNDFGNYSGQQQSNYGPMKGGSFGGRSSGSPYGGGYGSGGGSGGYGSRRF

SEQ ID NO: 845281 - protein, 209 aa, Homo sapiens
IVQKITFRAEDHLIVQKITLSCRRSPHRAEDHLSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGYDGYNEGGNFGGGNYGGGGNYNDFGNYSGQQQSNYGPMKGGSFGGRSSGSPYGGGYGSGGGSGGYGSRRF

SEQ ID NO: 845282 - protein, 209 aa, Homo sapiens; identical to SEQ ID NO: 845281

SEQ ID NO: 845283 - protein, 209 aa, Homo sapiens; identical to SEQ ID NO: 845281

SEQ ID NO: 845284 - protein, 209 aa, Homo sapiens; identical to SEQ ID NO: 845281

SEQ ID NO: 845285 - protein, 68 aa, Homo sapiens
RGVTVDMSGSGNYGGGGNYNDFGNYSGQQQSNYGPMKGGSFGGRSSGSPYGGGYGSGGGSGGYGSRRF

SEQ ID NO: 845286 - protein, 209 aa, Homo sapiens; identical to SEQ ID NO: 845281

SEQ ID NO: 845287 - protein, 68 aa, Homo sapiens; identical to SEQ ID NO: 845285

SEQ ID NO: 845288 - protein, 209 aa, Homo sapiens; identical to SEQ ID NO: 845281

SEQ ID NO: 845289 - protein, 209 aa, Homo sapiens; identical to SEQ ID NO: 845281

SEQ ID NO: 845290 - protein, 98 aa, Homo sapiens
VLLVMVNVMAKVVLMDTDDVVIIVVIMVVVVVPKVEVVVFNGSDKVVVMDLVVEVVDMVAEGSKNSRKGLNENPTCLNEECLSYHLKYEGFWLGKVCS

SEQ ID NO: 845291 - protein, 209 aa, Homo sapiens; identical to SEQ ID NO: 845281

SEQ ID NO: 845292 - protein, 209 aa, Homo sapiens; identical to SEQ ID NO: 845281

SEQ ID NO: 845293 - protein, 209 aa, Homo sapiens; identical to SEQ ID NO: 845281

SEQ ID NO: 845294 - protein, 209 aa, Homo sapiens; identical to SEQ ID NO: 845281

SEQ ID NO: 845295 - protein, 209 aa, Homo sapiens; identical to SEQ ID NO: 845281

SEQ ID NO: 845296 - protein, 209 aa, Homo sapiens; identical to SEQ ID NO: 845281

SEQ ID NO: 845297 - protein, 226 aa, Homo sapiens
IVQKITFRAEDHLIVQKITLSCRRSPHRAEDHLSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGYDGYNEGGNFGGGNYGGGGNYNDFGNYSGQQQSNYGPMKGGSFGGRSSGSPYGGGYGSGGGSGGYGSRRLKAAGYFETVVPNALEEL

SEQ ID NO: 845298 - protein, 174 aa, Homo sapiens
IVQKITFRAEDHLIVQKITLSCRRSPHRAEDHLSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGYDGYNEGGNFGGAMVVVGTIMISFKLKSFTGCFEG

SEQ ID NO: 845299 - protein, 134 aa, Homo sapiens
KVHSSISTKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKALSKQEMQSAGSQRGLEVDLAFYGHECSGTEIE

SEQ ID NO: 845300 - protein, 209 aa, Homo sapiens; identical to SEQ ID NO: 845281

SEQ ID NO: 845301 - protein, 209 aa, Homo sapiens; identical to SEQ ID NO: 845281

SEQ ID NO: 845302 - protein, 209 aa, Homo sapiens; identical to SEQ ID NO: 845281

SEQ ID NO: 845303 - protein, 209 aa, Homo sapiens; identical to SEQ ID NO: 845281

SEQ ID NO: 845304 - protein, 209 aa, Homo sapiens; identical to SEQ ID NO: 845281

SEQ ID NO: 845305 - protein, 209 aa, Homo sapiens; identical to SEQ ID NO: 845281

SEQ ID NO: 845306 - protein, 209 aa, Homo sapiens; identical to SEQ ID NO: 845281

SEQ ID NO: 845307 - protein, 188 aa, Homo sapiens
SCRRSPYRAEDHLIVQKITLSCRRSPHRAEDHLSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGNYGGGGNYNDFGNYSGQQQSNYGPMKGGSFGGRSSGSPYGGGYGSGGGSGGYGSRRF

SEQ ID NO: 845308 - protein, 209 aa, Homo sapiens; identical to SEQ ID NO: 845281

SEQ ID NO: 845309 - protein, 209 aa, Homo sapiens; identical to SEQ ID NO: 845281

SEQ ID NO: 845310 - protein, 209 aa, Homo sapiens; identical to SEQ ID NO: 845281

SEQ ID NO: 845311 - protein, 127 aa, Homo sapiens
MQNGEAHSVGSTHWQCPGKMCFLCCSWTEFSSSRARAAGEKGSICHARGQGSRVQDRGERICFGVQPVSRALLPLPRKDSGDSRSMGPRRSHVHPHMGLGPRPPKTRPSPARCRRAGLHAPPGLGPR

SEQ ID NO: 845312 - protein, 234 aa, Homo sapiens
SQQYASCTSGRLLLPPSATGGLSGWAASDDPIEKVIEGINRGLSNAEREVGKALDGINSGITHAGREVEKVFNGLSNMGSHTGKELDKGVQGLNHGMDKVAHEINHGIGQAGKGRKQTKRSKGSTLGSTRLGRKQRNLAKGSNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 845313 - protein, 134 aa, Homo sapiens
LGKRFYSSSPLFQAQRAVGDVGGNILGNVTQPASSSTLERLSTKTRRFSPLCNLEITIAASFSDPTQSTWTSGITLFSAGGLITLLLAAQGNHQSGSSSHQGGATTTPLASGASVNTPFINLPALWRSVANIMP

SEQ ID NO: 845314 - protein, 70 aa, Homo sapiens
LRVCIGVCESASYPEGNFGGNHELLNGNHQSGSSSHQGGATTTPLASGASVNTPFINLPALWRSVANIMP

SEQ ID NO: 845315 - protein, 249 aa, Homo sapiens
SQQYASCTSGRLLLPPSATGGLSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQGRKQTKRSKGSTLGSTRLGRKQRNLAKGSNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 845316 - protein, 250 aa, Homo sapiens
SQQYASCTSGRLLLPPSATGGLSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQVGKEADKLIHHGVHHGANQAGSEAGKFGQGNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 845317 - protein, 172 aa, Homo sapiens
SQQYASCTSGRLLLPPSATGGLSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQGNHQSGSSSHQGGATTTPLASGASVNTPFINLPALWRSVANIMP

SEQ ID NO: 845318 - protein, 472 aa, Homo sapiens
SQQYASCTSGRLLLPPSATGGLSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQVGKEADKLIHHGVHHGANQAGSEAGKFGQGLARGSTILLVRLGRRQRSLARGPTMLRGRPEMRQGRFGQGAHHAAGQAGNEAGRFGQGVHHGLSEGWKETEKFGQGVHHAASQFGKETEKLGHGVHHGVNEAWKEAEKFGQGVHHAASQVGKEEDRVVQGLHHGVSQAGREAGQFGHDIHHTAGQAGKEGDIAVHGVQPGVHEAGKEAGQFGQGVHHTLEQAGKEADKAVQGFHTGVHQAGKEAEKLGQGVVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 845319 - protein, 223 aa, Homo sapiens
DAHGTQRRTMAGENFATPFHGHVGRGAFSDVYEPAEDTFLLLDALEAAAAELAGVEICLEVGSGSGVVSAFLASMIGPQALYMCTDINPEAAACTLETARCNKVHIQPVITDLVKGLLPRLTEKVDLLVFNPPYVVTPPQEVGSHGIEAAWAGGRNGREVMDRFFPLVPDLLSPRGLFYLVTIKENNPEEILKIMKTKGLQGTTALSRQAGQETLSVLKFTKS

SEQ ID NO: 845320 - protein, 195 aa, Homo sapiens
DAHGTQRRTMAGENFATPFHGHVGRGAFSDVYEPAEDTFLLLDALEAAAAELAGVEICLEVGSGSGVVSAFLASMIGPQALYMCTDINPEAAACTLETARCNKVHIQPVITDLVGSHGIEAAWAGGRNGREVMDRFFPLVPDLLSPRGLFYLVTIKENNPEEILKIMKTKGLQGTTALSRQAGQETLSVLKFTKS

SEQ ID NO: 845321 - protein, 223 aa, Homo sapiens; identical to SEQ ID NO: 845319

SEQ ID NO: 845322 - protein, 223 aa, Homo sapiens; identical to SEQ ID NO: 845319

SEQ ID NO: 845323 - protein, 195 aa, Homo sapiens; identical to SEQ ID NO: 845320

SEQ ID NO: 845324 - protein, 58 aa, Homo sapiens
MPTSSAVLLRVLSIPLLTVLILARDLSALGGCPWGPLPLRCHCLLPDPLFCAGEVQAF

SEQ ID NO: 845325 - protein, 68 aa, Homo sapiens
PGEKGGHSAQGHARARTGHWPPPAESTRGKARLRVPRLTNVCCLCHRREKGKEGKRNKDITRCKWLDF

SEQ ID NO: 845326 - protein, 283 aa, Homo sapiens
PNMGFALERFAEAVDPALECKLCGQVLEEPLCTPCGHVFCASCLLPWAVRRRRCPLQCQPLAPGELYRVLPLRSLIQKLRVQCDYRARGCGHSVRLHELEAHVEHCDFGPARRLRSRGGCASGLGGGEVPARGGCGPTPRAGRGGGARGGPPGGRWGRGRGPGPRVLAWRRREKALLAQLWALQGEVQLTARRYQEKFTQYMAHVRNFVGDLGGGHRRDGEHKPFTIVLERENDTLGFNIIGGRPNQNNQEGTSTEGIYVSKILENGPADRADGLEIHDKIME

SEQ ID NO: 845327 - protein, 146 aa, Homo sapiens
AELCKERLCLRSFRHLRSFQHLRSFSLTETQPVVRDMSEHVTRSQSSERGNDQESSQPVGPVIVQQPTEEKRQEEEPPTDNQGIAPSGEIKNEGAPAVQGTDVEAFQQELALLKIEDAPGDGPDVREGTLPTFDPTKVLEAGEGQL

SEQ ID NO: 845328 - protein, 146 aa, Homo sapiens; identical to SEQ ID NO: 845327

SEQ ID NO: 845329 - protein, 130 aa, Homo sapiens
MQAPWAGNRGWAGTREEVRDMSEHVTRSQSSERGNDQESSQPVGPVIVQQPTEEKRQEEEPPTDNQGIAPSGEIKNEGAPAVQGTDVEAFQQELALLKIEDAPGDGPDVREGTLPTFDPTKVLEAGEGQL

SEQ ID NO: 845330 - protein, 130 aa, Homo sapiens; identical to SEQ ID NO: 845329

SEQ ID NO: 845331 - protein, 130 aa, Homo sapiens; identical to SEQ ID NO: 845329

SEQ ID NO: 845332 - protein, 222 aa, Homo sapiens
MALSAETESHIYRALRTASGAAAHLVALGFTIFVAVLARPGSSLFSWHPVLMSLAFSFLMTEALLVFSPESSLLHSLSRKGRARCHWVLQLLALLCALLGLGLVILHKEQLGKAHLVTRHGQAGLLAVLWAGLQCSGGVGLLYPKLLPRWPLAKLKLYHATSGLVGYLLGSASLLLGMCSLWFTASVTGAAWYLAVLCPVLTSLVIMNQVSNAYLYRKRIQP

SEQ ID NO: 845333 - protein, 222 aa, Homo sapiens; identical to SEQ ID NO: 845332

SEQ ID NO: 845334 - protein, 163 aa, Homo sapiens
MTEALLVFSPESSLLHSLSRKGRARCHWVLQLLALLCALLGLGLVILHKEQLGKAHLVTRHGQAGLLAVLWAGLQCSGGVGLLYPKLLPRWPLAKLKLYHATSGLVGYLLGSASLLLGMCSLWFTASVTGAAWYLAVLCPVLTSLVIMNQVSNAYLYRKRIQP

SEQ ID NO: 845335 - protein, 163 aa, Homo sapiens; identical to SEQ ID NO: 845334

SEQ ID NO: 845336 - protein, 222 aa, Homo sapiens; identical to SEQ ID NO: 845332

SEQ ID NO: 845337 - protein, 166 aa, Homo sapiens
MALSAETESHIYRALRTASGAAAHLVALGFTIFVAVLARPGSSLFSWHPVLMSLAFSFLMTEALLVFSPESSLLHSLSRKGRARCHWVLQLLALLCALLGLGLVILHKEQLGKAHLVTRHGQAGLLAVLWAGLQCSGGVGLLYPKLLPRWPLAKLKLYLYRKRIQP

SEQ ID NO: 845338 - protein, 222 aa, Homo sapiens; identical to SEQ ID NO: 845332

SEQ ID NO: 845339 - protein, 272 aa, Homo sapiens
LPVKNNNICNILRYGLCAYVVTSAYRGYGNISEHICTAAEAWLQPLARLTMALSAETESHIYRALRTASGAAAHLVALGFTIFVAVLARPGSSLFSWHPVLMSLAFSFLMTEALLVFSPESSLLHSLSRKGRARCHWVLQLLALLCALLGLGLVILHKEQLGKAHLVTRHGQAGLLAVLWAGLQCSGGVGLLYPKLLPRWPLAKLKLYHATSGLVGYLLGSASLLLGMCSLWFTASVTGAAWYLAVLCPVLTSLVIMNQVSNAYLYRKRIQP

SEQ ID NO: 845340 - protein, 213 aa, Homo sapiens
MALSAETESHIYRALRTASGAAAHLVALGFTIFVAVLARPGSSLFSWHPVLMSLAFSFLMTEALLVFSPESSLLHSLSRKGRARCHWVLQLLALLCALLGLGLVILHKEQLGKAHLVTRHGQAGLLAVLWAGLQCSGGVGLLYPKLLPRWPLAKLKLYLLGSASLLLGMCSLWFTASVTGAAWYLAVLCPVLTSLVIMNQVSNAYLYRKRIQP

SEQ ID NO: 845341 - protein, 222 aa, Homo sapiens; identical to SEQ ID NO: 845332

SEQ ID NO: 845342 - protein, 180 aa, Homo sapiens [sequence omitted]

SEQ ID NO: 845343 - protein, 398 aa, Homo sapiens
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 845344 - protein, 308 aa, Homo sapiens
GKHAKSSFKQFLLQIKELSNPIDLDSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 845345 - protein, 398 aa, Homo sapiens; identical to SEQ ID NO: 845343

SEQ ID NO: 845346 - protein, 398 aa, Homo sapiens; identical to SEQ ID NO: 845343

SEQ ID NO: 845347 - protein, 219 aa, Homo sapiens
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQISF

SEQ ID NO: 845348 - protein, 223 aa, Homo sapiens
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQVRPGKVE

SEQ ID NO: 845349 - protein, 225 aa, Homo sapiens
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQYEKIRRLLW

SEQ ID NO: 845350 - protein, 398 aa, Homo sapiens; identical to SEQ ID NO: 845343

SEQ ID NO: 845351 - protein, 398 aa, Homo sapiens; identical to SEQ ID NO: 845343

SEQ ID NO: 845352 - protein, 398 aa, Homo sapiens; identical to SEQ ID NO: 845343

SEQ ID NO: 845353 - protein, 398 aa, Homo sapiens; identical to SEQ ID NO: 845343

SEQ ID NO: 845354 - protein, 115 aa, Homo sapiens
MTALRGSVGNKKNESLSFCPQILTFPKCLKRNQTNALSGNFCVILLLKPNSTFSCCFFFFFFFFWLPSHSCQVCGSFLEPREILLPPFADVVLSWAHLGPRHSQGTVRPGCLPGP

SEQ ID NO: 845355 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 845356 - protein, 980 aa, Homo sapiens
MWVPVLALPVCTYAETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 845357 - protein, 304 aa, Homo sapiens
HSYGVDIQVSLRLDPDNLRYYEFMDADPFPQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 845358 - protein, 210 aa, Homo sapiens
MHRGLSGLGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 845359 - protein, 496 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKVPIGWVLSPSPTSLRAPLPG

SEQ ID NO: 845360 - protein, 233 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCITGTSLS

SEQ ID NO: 845361 - protein, 132 aa, Homo sapiens
LGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGKGQGGARAPANA

SEQ ID NO: 845362 - protein, 986 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 845363 - protein, 986 aa, Homo sapiens; identical to SEQ ID NO: 845362

SEQ ID NO: 845364 - protein, 668 aa, Homo sapiens
MPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 845365 - protein, 301 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRERQDLTMLSRLVLNSWPQMILPPQPPKVLEL

SEQ ID NO: 845366 - protein, 240 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFYCNGDGEWLVPIGRCMCKAGFEAVENGTVCRERQDLTMLSRLVLNSWPQMILPPQPPKVLEL

SEQ ID NO: 845367 - protein, 124 aa, Homo sapiens
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNVCIWDNLFQGNIIGVLLFY

SEQ ID NO: 845368 - protein, 362 aa, Homo sapiens
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFEKKMQRQHELSESCSASALQARLKVAAHEAEEESDNIAEDFLEGKMENLPL

SEQ ID NO: 845369 - protein, 349 aa, Homo sapiens
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFEKKMQRQHELSEICHCRRAKEEKLQQAIAMHSQFHAPL

SEQ ID NO: 845370 - protein, 397 aa, Homo sapiens
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFEKKMQRQHELSESCSASALQARLKVAAHEAEEESDNIAEDFLEGKMEIDDFLSSFMEKRTICHCRRAKEEKLQQAIAMHSQFHAPL

SEQ ID NO: 845371 - protein, 168 aa, Homo sapiens
MPDVPDAFPELSELSVSQLTDMNEQEEVLLEQFLTLPQLKQIITDKDDLVKSIEELARKNLLLEPSLEAKRQTVLDKMKSTFEKKMQRQHELSESCSASALQARLKVAAHEAEEESDNIAEDFLEGKMEIDDFLSSFMEKRTICHCRRAKEEKLQQAIAMHSQFHAPL

SEQ ID NO: 845372 - protein, 297 aa, Homo sapiens
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSKDPKRGTE

SEQ ID NO: 845373 - protein, 397 aa, Homo sapiens; identical to SEQ ID NO: 845370

SEQ ID NO: 845374 - protein, 397 aa, Homo sapiens; identical to SEQ ID NO: 845370

SEQ ID NO: 845375 - protein, 408 aa, Homo sapiens
MSWLFPLTKSASSSAAGSPGGLTSLQQQKQRLIESLRNSHSRLERSGAISVHCNLRLPDSSNHPPSAPHTPPSSWDYRLLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFEKKMQRQHELSESCSASALQARLKVAAHEAEEESDNIAEDFLEGKMEIDDFLSSFMEKRTICHCRRAKEEKLQQAIAMHSQFHAPL

SEQ ID NO: 845376 - protein, 455 aa, Homo sapiens
QKLTEEPACGGAVGSTESDAWSVCWASRDQSWVMTYLFRSSSHIYTYIDPAANATCTDTHNEDGGAGRSVTWITKKDTAVQHELDIEMSHPAPLSLENRRAEPLGEAGQSLPGPPARGPEEDELAFSPDQERLLLRGWVPRWPHQPPAAEAAPDRVPPELTLQFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFEKKMQRQHELSESCSASALQARLKVAAHEAEEESDNIAEDFLEGKMEIDDFLSSFMEKRTICHCRRAKEEKLQQAIAMHSQFHAPL

SEQ ID NO: 845377 - protein, 174 aa, Homo sapiens [sequence omitted]

SEQ ID NO: 845378 - protein, 225 aa, Homo sapiens
FWGLCSFGSLLFWGLCSFGVFPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFEKKMQRQHELSESCSASALQARLKVAAHEAEEESDNIAEDFLEGKMEIDDFLSSFMEKRTICHCRRAKEEKLQQAIAMHSQFHAPL

SEQ ID NO: 845379 - protein, 397 aa, Homo sapiens; identical to SEQ ID NO: 845370

SEQ ID NO: 845380 - protein, 177 aa, Homo sapiens
QKLTRSLRVGARWAVRNLMHGQYAGRLRDQSWVMTYLFRSSSHIYTYIDPAATRRVLIHTMKIGGAGRSVTWITKKDTAVQHELDIEMSHPAPLSLENRRAEPLGEAGQSLPGPPARGPEEDELAFSPDQERLLLRGWVPRWPHQPPAAEAAPDRVPPELTLQIVYFQYPLLPRLRH

SEQ ID NO: 845381 - protein, 557 aa, Homo sapiens
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMERYFDGNLEKLFAECHVINPSKKSRTRQMNTRSSAQDMPCQICYLNYPNSYFTGLECGHKFCMQCWSEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 845382 - protein, 557 aa, Homo sapiens; identical to SEQ ID NO: 845381

SEQ ID NO: 845383 - protein, 557 aa, Homo sapiens; identical to SEQ ID NO: 845381

SEQ ID NO: 845384 - protein, 509 aa, Homo sapiens
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMESISLALNVDISFVCSAGDEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 845385 - protein, 459 aa, Homo sapiens
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMERRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 845386 - protein, 427 aa, Homo sapiens
PIEVAKEYSCDKEKLMERYFDGNLEKLFAECHVINPSKKSRTRQMNTRSSAQDMPCQICYLNYPNSYFTGLECGHKFCMQCWSEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 845387 - protein, 198 aa, Homo sapiens
MVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 845388 - protein, 557 aa, Homo sapiens; identical to SEQ ID NO: 845381

SEQ ID NO: 845389 - protein, 166 aa, Homo sapiens
MCYNYITQFFLMGQRSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 845390 - protein, 524 aa, Homo sapiens
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMERYFDGNLEKLFAECHVINPSKKSRTRQMNTRSSAQDMPCQICYLNYPNSYFTGLECGHKFCMQCWSEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFEIPQRLDNAKGCSCLPGRDIPKIFEDIGDLFSL

SEQ ID NO: 845391 - protein, 557 aa, Homo sapiens; identical to SEQ ID NO: 845381

SEQ ID NO: 845392 - protein, 580 aa, Homo sapiens
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQCIIGYFQKYEFSDAKDRRAAAAKNPATITRILLSHFNWDKEKLMERYFDGNLEKLFAECHVINPSKKSRTRQMNTRSSAQDMPCQICYLNYPNSYFTGLECGHKFCMQCWSEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 845393 - protein, 412 aa, Homo sapiens
MERYFDGNLEKLFAECHVINPSKKSRTRQMNTRSSAQDMPCQICYLNYPNSYFTGLECGHKFCMQCWSEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 845394 - protein, 557 aa, Homo sapiens; identical to SEQ ID NO: 845381

SEQ ID NO: 845395 - protein, 557 aa, Homo sapiens; identical to SEQ ID NO: 845381

SEQ ID NO: 845396 - protein, 111 aa, Homo sapiens [sequence omitted]

SEQ ID NO: 845397 - protein, 309 aa, Homo sapiens
MSLEQRSLHCKPEEALEAQQEALGLVCVQAATSSSSPLVLGTLEEVPTAGSTDPPQSPQGASAFPTTINFTRQRQPSEGSSSREEEGPSTSCILESLFRAVITKKVADLVGFLLLKYRAREPVTKAEMLESVIKNYKHCFPEIFGKASESLQLVFGIDVKEADPTGHSYVLVTCLGLSYDGLLGDNQIMPKTGFLIIVLVMIAMEGGHAPEEEIWEELSVMEVYDGREHSAYGEPRKLLTQDLVQEKYLEYRQVPDSDPARYEFLWGPRALAETSYVKVLEYVIKVSARVRFFFPSLREAALREEEEGV

SEQ ID NO: 845398 - protein, 472 aa, Homo sapiens
WKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLASSWSRHKPTWEEFPSQWGLPSPPAPCFTQLPGRRRCLAHRGGGLCVCALRCGGQMSSLPGSTSCVQMVSSWGGGGKREAGHWGTGLGLILLDSVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 845399 - protein, 215 aa, Homo sapiens
WKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLSVPSGVAVRCPVCLEAPLVSRCLLQTPGALDPGTAGPPHPTGCCSGPHLPAPTVR

SEQ ID NO: 845400 - protein, 380 aa, Homo sapiens
RWYGRKYGITAAMLNPPPAGSLTSWNVSMDTQAQQLILHFSSRMHATFSAAWSLPGLGQDTLVPPVYTVSQARGSSPVSLDLIIPFLRPGCCVLASSWSRHKPTWEEFPSQWGLPSPPAPCFTQLPGRRRCLAHRGGGLLCLCPQVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 845401 - protein, 143 aa, Homo sapiens
WKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQVWPRPH

SEQ ID NO: 845402 - protein, 114 aa, Homo sapiens
SPSCREPPRAAACSCTSRGTDLDPSYHRLLWHSVFGVISCYQLRRQRIAQRSTWNLTAPSMFQQLAPASPQGIKFGILSLETQVLAELLILSQDSVIEDTRPEERDVAGASYTS

SEQ ID NO: 845403 - protein, 729 aa, Homo sapiens
IRERVRGRPRVLWRLSKSPGAQFPEAVSSERSSCTVVSQVCESPTMSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLPGHTNDVMVNMIALTALHTEEENYNVVAPGCLSQSSDTTAKALWEALLNTKHKEAVMEVRRHLVEAASRENLPIKMSMGRVTPGQLMSYIQLFKNNLKALMNHCGLLQLGLATAQTLKHPQTAKWDNFLAFERLLLQSIGESAMSVVLNQLLPMIKPVTQRTNEDYSPEELLILLIYIYSVTGELTVDKDLCEAEEKVKKALAQVFCEESGLSPLLQKITDWDSSINLTFHKSKIAVDELFTSLRDIAGARSLLKQFKSVYVPGNHTHQASYKPLLKQVVEEIFHPERPDSVDIEHMSSGLTDLLKTGFSMFMKVSRPHPSDYPLLILFVVGGVTVSEVKMVKDLVASLKPGTQVIVLSTRLLKPLNIPELLFATDRLHPDLGF

SEQ ID NO: 845404 - protein, 711 aa, Homo sapiens
IRERVRGRPRVLWRLSKSPGAQFPEAVSSERSSCTVVSQVCESPTMSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLPGHTNDVMVNMIALTALHTEEENYNVVAPGCLSQSSDTTAKALWEALLNTKHKEAVMEVRRHLVEAASRAYIQLFKNNLKALMNHCGLLQLGLATAQTLKHPQTAKWDNFLAFERLLLQSIGESAMSVVLNQLLPMIKPVTQRTNEDYSPEELLILLIYIYSVTGELTVDKDLCEAEEKVKKALAQVFCEESGLSPLLQKITDWDSSINLTFHKSKIAVDELFTSLRDIAGARSLLKQFKSVYVPGNHTHQASYKPLLKQVVEEIFHPERPDSVDIEHMSSGLTDLLKTGFSMFMKVSRPHPSDYPLLILFVVGGVTVSEVKMVKDLVASLKPGTQVIVLSTRLLKPLNIPELLFATDRLHPDLGF

SEQ ID NO: 845405 - protein, 567 aa, Homo sapiens
IRERVRGRPRVLWRLSKSPGAQFPEAVSSERSSCTVVSQVCESPTMSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLPGHTNDVMVNMIALTALHTEEENYNVVAPGCLSQSSDTTAKALWEALLNTKHKEAVMEVRRHLVEAASRENLPIKMSMGRVTPGQLMSYIQLFKNNLKALMNHCGLLQLGLATAQTLKHPQTAKWDNFLAFERLLLQSIGESAMSVVLNQLLPMIKPVTQRTNEDYSPEELLILLIYIYSVTGELTVDKDLCEAEEKVKKALAQVFCEESGLSPLLQKITGH

SEQ ID NO: 845406 - protein, 492 aa, Homo sapiens
IRERVRGRPRVLWRLSKSPGAQFPEAVSSERSSCTVVSQVCESPTMSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLPGHTNDVMVNMIALTALHTEEENYNVVAPGCLSQSSDTTAKALWEALLNTKHKEAVMEVRRHLVEAASRENLPIKMSMGRVTPGQLMSYIQLFKNNLKALMNHCGLLQLGLATAQTLKHPQTAKWDNFLAFERLLLQVCCYGNLVGS

SEQ ID NO: 845407 - protein, 729 aa, Homo sapiens; identical to SEQ ID NO: 845403

SEQ ID NO: 845408 - protein, 415 aa, Homo sapiens
IRERVRGRPRVLWRLSKSPGAQFPEAVSSERSSCTVVSQVCESPTMSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLVSRPHPSDYPLLILFVVGGVTVSEVKMVKDLVASLKPGTQVIVLSTRLLKPLNIPELLFATDRLHPDLGF

SEQ ID NO: 845409 - protein, 108 aa, Homo sapiens [sequence omitted]

SEQ ID NO: 845410 - protein, 1522 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKAEVAGSKVVPALPESGQSEPGPPEVEGGTKATGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 845411 - protein, 1869 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKAEVAGSKVVPALPESGQSEPGPPEVEGGTKATGNNFLLGAKDRPRLECGTCEGRVGPLPMVTHTPTSSLSCLEWGGGRSGSKDGEIWFYRLAVHPALRSHLSRLLFRMAGINACVQLWEGQGSLAWGWGPSVLHLICKQPLPHLSRRSSVTVEMAERASQIPRWFSVLPACQEPSTSFLQLSLTPLGWVKGPPEDRGMDGRGAGQGCSSSRAGVRQGKRAAACSFQKSLKPAHNLFTQGGGATPISPNETLQLCHFSLEFIAQHLPQLGARLSKCHLEGLGSRAFRGLADSEQGPRSLSLSGEDCLACSVRWLGNPTGTGGELRLLCLPPDLILFTVGTGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 845412 - protein, 994 aa, Homo sapiens
SVPREDKRREVLALTKEVILLLADPLCCLKRREDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 845413 - protein, 526 aa, Homo sapiens
MGVAVEDDIRGPGISSVPYVSGFQVVLKIHICLVLHSPSALRVRALSPTLSPWPRLQSHLPSLVQTLLPSFPHTDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 845414 - protein, 158 aa, Homo sapiens
MPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 845415 - protein, 1561 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTLAAKLLPPSLDFSSSQDGDHGGFLPHLCPPLPHPVPVENQ

SEQ ID NO: 845416 - protein, 1530 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 845417 - protein, 1249 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGGQQQEEEQQQEVLLLLLGVGEAGPVWLSETKRDGDGGLARGGGWEESCPARWRSKPMPVTGVSTGAREDGLCSGELI

SEQ ID NO: 845418 - protein, 704 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSL

SEQ ID NO: 845419 - protein, 642 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDR

SEQ ID NO: 845420 - protein, 109 aa, Homo sapiens
MALLSEIHFSLSERFWQLSSTPGISICSLPAPDSWCEAMKKLREEGPIIKEISDLMLARVWLQTSPSWQGGDWGRQGLITQGQRIWQRQGSGPRQGFDAWPRVHSASSV

SEQ ID NO: 845421 - protein, 1530 aa, Homo sapiens; identical to SEQ ID NO: 845416

SEQ ID NO: 845422 - protein, 1545 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKSEPGPPEVEGGTKATGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 845423 - protein, 517 aa, Homo sapiens
YRIRSPGTLCHFSKELLIPVFCSSNKDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 845424 - protein, 120 aa, Homo sapiens
TTKSSASLKEVGGIPTLLPVEEAVRETRIQPRPGGRPACCLVCSSRSQVSVSFPSLSPTLQGLMSPKHADCIRKAPTHHGLPSPHICVYTRTPVCALPSDMQVKGGGFCVNALSSSPLSP

SEQ ID NO: 845425 - protein, 1368 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKEVK

SEQ ID NO: 845426 - protein, 957 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGSTWGGAGITGSGPRARPSF

SEQ ID NO: 845427 - protein, 350 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQVSDLEPPCSFPFLRSEIWRHGCYQYIVLD

SEQ ID NO: 845428 - protein, 139 aa, Homo sapiens
MSSCMILCSPCSSHFLLPLSPPPALSPSCSLSLPFPCVLVSPLPGGGGVGAAEVAGSKVVPALPESGQSEPGPPEVEGGTKATGNNFLLGAKDRPRLECGTCEGRVGPLPMVTHTPTSSLSCLEWGGGRSGSKDGEIWF

SEQ ID NO: 845429 - protein, 128 aa, Homo sapiens
PLLFPSFFARLSADSSSSVHDLLVAAMSARVRSRSRGRGDGQEAPDVVAFVAPGESQQEEPPTDNQDIEPGQEREGTPPIEERKVEGDCQEMDLEKTRSERGDGSDVKEKTPPNPKHAKTKEAGDGQP

SEQ ID NO: 845430 - protein, 123 aa, Homo sapiens
STFARLSADSSSSVHDLLVAAMSARVRSRSRGRGDGQEAPDVVAFVAPGESQQEEPPTDNQDIEPGQEREGTPPIEERKVEGDCQEMDLEKTRSERGDGSDVKEKTPPNPKHAKTKEAGDGQP

SEQ ID NO: 845431 - protein, 128 aa, Homo sapiens; identical to SEQ ID NO: 845429

SEQ ID NO: 845432 - protein, 128 aa, Homo sapiens
PLLFPSFFARLSADSSSSVHDLLVAAMSARVRSRSRGRGDGQEAPDVVAFVAPGESQQEEPPTDNQDIEPGQEREGTPPIEERKVEGDCQEMDLEKTRSERGDGSDVKAVTPSYPVHQQARMPTYVLL

SEQ ID NO: 845433 - protein, 128 aa, Homo sapiens; identical to SEQ ID NO: 845429

SEQ ID NO: 845434 - protein, 128 aa, Homo sapiens; identical to SEQ ID NO: 845429

SEQ ID NO: 845435 - protein, 103 aa, Homo sapiens
MTNYSDTWWQGRYLLLGGSCLLGTRTATSGRVGAAAQGVSWLSCGLLRCLWSPSYQEQRHGHAGRGRRGRWCAGRSCLGVGGLGLVCRLKRSLAGKVTSGLVP

SEQ ID NO: 845436 - protein, 121 aa, Homo sapiens
RARGLGCLPSQPACPRWPSPAAKQTVSSGPASPSRWDMSIGSARLPTKAGTDLELGFGTACPNPREPGQGERQARAALSQVPLALSHPGHWGQSGDGNQPGTVWHPPTRPSGSHWPRTRDF

SEQ ID NO: 845437 - protein, 118 aa, Homo sapiens
SLREFGPQAQNSAREILAPFCTLKCKNVAEENTRVLYSLYGVVEHSGTMRSGHYTAYAKARTANSHLSNLVLHGDIPQDFEMESKGQWFHISDTHVQAVPTTKVLNSQAYLLFYERIL

SEQ ID NO: 845438 - protein, 156 aa, Homo sapiens
MGKKRTKGKTVPIDDSSETLEPVCRHIRKGLEQGNLKKALVNVEWNICQDCKTDNKVKDKAEEETEEKPSVWLCLKCGHQGCGRNSQEQHALKHYLTPRSEPHCLVLSLDNWSVWCYVCDNEVQYCSSNQLGQVVDYVRKQASITTPKPAEKDMEI

SEQ ID NO: 845439 - protein, 823 aa, Homo sapiens
MGKKRTKGKTVPIDDSSETLEPVCRHIRKGLEQGNLKKALVNVEWNICQDCKTDNKVKDKAEEETEEKPSVWLCLKCGHQGCGRNSQEQHALKHYLTPRSEPHCLVLSLDNWSVWCYVCDNEVQYCSSNQLGQVVDYVRKQASITTPKPAEKDNGNIELENKKLEKESKNEQEREKKENMAKENPPMNSPCQITVKGLSNLGNTCFFNAVMQNLSQTPVLRELLKEVKMSGTIVKIEPPDLALTEPLEINLEPPGPLTLAMSQFLNEMQETKKGVVTPKELFSQVCKKAVRFKGYQQQDSQELLRYLLDGMRAEEHQRVSKGILKAFGNSTEKLDEELKNKVKDYEKKKSMPSFVDRIFGGELTSMIMCDQCRTVSLVHESFLDLSLPVLDDQSGKKSVNDKNLKKTVEDEDQDSEEEKDNDSYIKERSDIPSGTSKHLQKKAKKQAKKQAKNQRRQQKIQGKVLHLNDICTIDHPEDSEYEAEMSLQGEVNIKSNHISQEGVMHKEYCVNQKDLNGQAKMIESVTDNQKSTEEVDMKNINMDNDLEVLTSSPTRNLNGAYLTEGSNGEVDISNGFKNLNLNAALHPDEINIEILNDSHTPGTKVYEVVNEDPETAFCTLANREVFNTDECSIQHCLYQFTRNEKLRDANKLLCEVCTRRQCNGPKANIKGERKHVYTNAKKQMLISLAPPVLTLHLKRFQQAGFNLRKVNKHIKFPEILDLAPFCTLKCKNVAEENTRVLYSLYGVVEHSGTMRSGHYTAYAKARTANSHLSNLVLHGDIPQDFEMESKGQWFHISDTHVQAVPTTKVLNSQAYLLFYERIL

SEQ ID NO: 845440 - protein, 644 aa, Homo sapiens
MAKENPPMNSPCQITVKGLSNLGNTCFFNAVMQNLSQTPVLRELLKEVKMSGTIVKIEPPDLALTEPLEINLEPPGPLTLAMSQFLNEMQETKKGVVTPKELFSQVCKKAVRFKGYQQQDSQELLRYLLDGMRAEEHQRVSKGILKAFGNSTEKLDEELKNKVKDYEKKKSMPSFVDRIFGGELTSMIMCDQCRTVSLVHESFLDLSLPVLDDQSGKKSVNDKNLKKTVEDEDQDSEEEKDNDSYIKERSDIPSGTSKHLQKKAKKQAKKQAKNQRRQQKIQGKVLHLNDICTIDHPEDSEYEAEMSLQGEVNIKSNHISQEGVMHKEYCVNQKDLNGQAKMIESVTDNQKSTEEVDMKNINMDNDLEVLTSSPTRNLNGAYLTEGSNGEVDISNGFKNLNLNAALHPDEINIEILNDSHTPGTKVYEVVNEDPETAFCTLANREVFNTDECSIQHCLYQFTRNEKLRDANKLLCEVCTRRQCNGPKANIKGERKHVYTNAKKQMLISLAPPVLTLHLKRFQQAGFNLRKVNKHIKFPEILDLAPFCTLKCKNVAEENTRVLYSLYGVVEHSGTMRSGHYTAYAKARTANSHLSNLVLHGDIPQDFEMESKGQWFHISDTHVQAVPTTKVLNSQAYLLFYERIL

SEQ ID NO: 845441 - protein, 408 aa, Homo sapiens
MGKKRTKGKTVPIDDSSETLEPVCRHIRKGLEQGNLKKALVNVEWNICQDCKTDNKVKDKAEEETEEKPSVWLCLKCGHQGCGRNSQEQHALKHYLTPRSEPHCLVLSLDNWSVWCYVCDNEVQYCSSNQLGQVVDYVRKQASITTPKPAEKDNGNIELENKKLEKESKNEQEREKKENMAKENPPMNSPCQITVKGLSNLGNTCFFNAVMQNLSQTPVLRELLKEVKMSGTIVKIEPPDLALTEPLEINLEPPGPLTLAMSQFLNEMQETKKGVVTPKELFSQVCKKAVRFKGYQQQDSQELLRYLLDGMRAEEHQRVSKGILKAFGNSTEKLDEELKNKVKDYEKKKSMPSFVDRIFGGELTSMIMCDQCRTVSLVHESFLDLSLPVLDDQVRLLNLFYSSRFFFL

SEQ ID NO: 845442 - protein, 474 aa, Homo sapiens
MGKKRTKGKTVPIDDSSETLEPVCRHIRKGLEQGNLKKALVNVEWNICQDCKTDNKVKDKAEEETEEKPSVWLCLKCGHQGCGRNSQEQHALKHYLTPRSEPHCLVLSLDNWSVWCYVCDNEVQYCSSNQLGQVVDYVRKQASITTPKPAEKDNGNIELENKKLEKESKNEQEREKKENMAKENPPMNSPCQITVKGLSNLGNTCFFNAVMQNLSQTPVLRELLKEVKMSGTIVKIEPPDLALTEPLEINLEPPGPLTLAMSQFLNEMQETKKGVVTPKELFSQVCKKAVRFKGYQQQDSQELLRYLLDGMRAEEHQRVSKGILKAFGNSTEKLDEELKNKVKDYEKKKSMPSFVDRIFGGELTSMIMCDQCRTVSLVHESFLDLSLPVLDDQSGKKSVNDKNLKKTVEDEDQDSEEEKDNDSYIKERSDIPSGTSKHLQKKAKKQAKKQAKPAEKDNGNIELENKKLEKESKY

SEQ ID NO: 845443 - protein, 823 aa, Homo sapiens; identical to SEQ ID NO: 845439

SEQ ID NO: 845444 - protein, 46 aa, Homo sapiens
MGKKRTKGKTVPIDDSSETLGNLCADTLRTRDLDTKVHLDTAHGFS

SEQ ID NO: 845445 - protein, 823 aa, Homo sapiens; identical to SEQ ID NO: 845439

SEQ ID NO: 845446 - protein, 823 aa, Homo sapiens; identical to SEQ ID NO: 845439

SEQ ID NO: 845447 - protein, 143 aa, Homo sapiens [sequence omitted]

SEQ ID NO: 845448 - protein, 66 aa, Homo sapiens
HGSSIWWGSVLHYPMVEGQRAEGRRGKAEEKDSMGDSKKMEAKTYPFIRNPLPHMFVNNAIRNKSV

SEQ ID NO: 845449 - protein, 107 aa, Homo sapiens
MYLLQSTDLKRICKTIVEAASDDERRKAFAPIQEMMTFVQFANDECDYGMGLELGMDLFCYGSHYFHKVAGQLLPLAYNLLKRNLFAEIMKDHLANRRKENIDQFAA

SEQ ID NO: 845450 - protein, 149 aa, Homo sapiens
FGWRCSCRMVGGGWKRRPGAGAGPQILPERLWGLRRWLWMTARVPGGSAFHSCSDYEACCVSGVCGLLRGPCPGRCFALCRGLDQCEKTVDVKKSKFCEADVSSDLRKEVENHYTLSLPEDFYHFWKFCEELDSEKPAEIHFLQALDFN

SEQ ID NO: 845451 - protein, 376 aa, Homo sapiens
MADYWKSQPKKFCDYCKCWIADNRPSVEFHERGKNHKENVAKRISEIKQKSLDKAKEEEKASKEFAAMEAAALKAYQEDLKRLGLESEILEPSITPVTSTIPPTSTSNQQKEKKEKKKRKKDPSKGRWVEGITSEGYHYYYDLISGASQWEKPEGFQGDLKKTAVKTVWVEGLSEDGFTYYYNTETGESRWEKPDDFIPHTSDLPSSKVNENSLGTLDESKSSDSHSDSDGEQEAEEGGVSTETEKPKIKFKEKNKNSDGGSDPETQKEKSIQKQNSLGSNEEKSKTLKKSNPYGEWQEIKQEVESHEEVDLELPSTENEYVSTSEADGGGEPKVVFKEKTVTSLGVMADGVAPVFKKRRTENGKSRNLRQRGDDQ

SEQ ID NO: 845452 - protein, 386 aa, Homo sapiens
GRNVTPLNALGADYWKSQPKKFCDYCKCWIADNRPSVEFHERGKNHKENVAKRISEIKQKSLDKAKEEEKASKEFAAMEAAALKAYQEDLKRLGLESEILEPSITPVTSTIPPTSTSNQQKEKKEKKKRKKDPSKGRWVEGITSEGYHYYYDLISGASQWEKPEGFQGDLKKTAVKTVWVEGLSEDGFTYYYNTETGESRWEKPDDFIPHTSDLPSSKVNENSLGTLDESKSSDSHSDSDGEQEAEEGGVSTETEKPKIKFKEKNKNSDGGSDPETQKEKSIQKQNSLGSNEEKSKTLKKSNPYGEWQEIKQEVESHEEVDLELPSTENEYVSTSEADGGGEPKVVFKEKTVTSLGVMADGVAPVFKKRRTENGKSRNLRQRGDDQ

SEQ ID NO: 845453 - protein, 167 aa, Homo sapiens
MADYWKSQPKKFCDYCKCWIADNRPSVEFHERGKNHKENVAKRISEIKQKSLDKAKEEEKASKEFAAMEAAALKAYQEDLKRLGLESEILEPSITPVTSTIPPTSTSNQQKEKKEKKKRKKDPSKGRWVEGITSEGYHYYYDLISGASQWEKPEGFQGDLKKVIEAY

SEQ ID NO: 845454 - protein, 198 aa, Homo sapiens
MADYWKSQPKKFCDYCKCWIADNRPSVEFHERGKNHKENVAKRISEIKQKSLDKAKEEEKASKEFAAMEAAALKAYQEDLKRLGLESEILEPSITPVTSTIPPTSTSNQQKEKKEKKKRKKDPSKGRWVEGITSEGYHYYYDLISGASQWQKPEGFHGDFTTALKTGWLKVYAHDAFTYPIPLLRCNPLHARALIPTS

SEQ ID NO: 845455 - protein, 376 aa, Homo sapiens; identical to SEQ ID NO: 845451

SEQ ID NO: 845456 - protein, 159 aa, Homo sapiens
MADYWKSQPKKFCDYCKCWIADNRPSVEFHERGKNHKENVAKRISEIKQKSLDKAKEEEKASKEFAAMEAAALKAYQEDLKRLGLESEILEPSITPVTSTIPPTSTSNQQKEKKEKKKRKKDPSKGRWEQMRPSGKCLLFLVPPHCLFHPCTDLGGSDS

SEQ ID NO: 845457 - protein, 150 aa, Homo sapiens
GRQNVRPGPRRAEAAVVTCGGPVTQSRGAGTRLAEPAGERRPQARARRRDSTYLPGFGSGSAGRGAAGALPPSFLLPSPPPRGATHNTRRKRKPRRGSCQWKLGCRRAAAAGSSGACGRRRRRAGDEKQQGESRARRDPEGQVAEMLASR

SEQ ID NO: 845458 - protein, 150 aa, Homo sapiens; identical to SEQ ID NO: 845457

SEQ ID NO: 845459 - protein, 150 aa, Homo sapiens; identical to SEQ ID NO: 845457

SEQ ID NO: 845460 - protein, 150 aa, Homo sapiens; identical to SEQ ID NO: 845457

SEQ ID NO: 845461 - protein, 71 aa, Homo sapiens
ERIEREIPDRETTEYINDTWPCLAKFTEIIYLSRWSGSRGRAGTASLLLTFVSLAPSHGVRPQHVRWINAC

SEQ ID NO: 845462 - protein, 150 aa, Homo sapiens; identical to SEQ ID NO: 845457

SEQ ID NO: 845463 - protein, 150 aa, Homo sapiens; identical to SEQ ID NO: 845457

SEQ ID NO: 845464 - protein, 150 aa, Homo sapiens; identical to SEQ ID NO: 845457

SEQ ID NO: 845465 - protein, 150 aa, Homo sapiens; identical to SEQ ID NO: 845457

SEQ ID NO: 845466 - protein, 150 aa, Homo sapiens; identical to SEQ ID NO: 845457

SEQ ID NO: 845467 - protein, 136 aa, Homo sapiens
GRQNVRPGPRRAEAAVVTCGGPVTQSRGAGTRLAEPAGERRPQARARRRDSTYLPGFGSGSAGRGAAGALPPSFLLPSPPPRGATHNTRRKRKPRRGSCKSLAVKNPRTLTASVFCSQLLILDSTRDSPFLSAFMI

SEQ ID NO: 845468 - protein, 150 aa, Homo sapiens; identical to SEQ ID NO: 845457

SEQ ID NO: 845469 - protein, 150 aa, Homo sapiens; identical to SEQ ID NO: 845457

SEQ ID NO: 845470 - protein, 113 aa, Homo sapiens
MSGRALLPNLWTVSKHKITIPDNSVTKIWVSLGRRGSWEMIQSNLPQTKHHGLLSCFTNHLNVLVILKIDALFPRKEVLPHFPSGRHLYPYSFILSFPPPHPPPPTQHLQFLN

SEQ ID NO: 845471 - protein, 75 aa, Homo sapiens
SSRMSYQQQQCKQPCQPPPVCPTPKCPEPCPPPKCPEPCPPPKCPQPCPPQQCQQKYPPVTPSPPCQPKYPPKSK

SEQ ID NO: 845472 - protein, 192 aa, Homo sapiens
MAPLGGAPRLVLLFSGKRKSGKDFVTEALQSRLGADVCAVLRLSGPLKEQYAQEHGLNFQRLLDTSTYKEAFRKDMIRWGEEKRQADPGFFCRKIVEGISQPIWLVSDTRRVSDIQWFREAYGAVTQTVRVVALEQSRQQRGWVFTPGVDDAESECGLDNFGDFDWVIENHGVEQRLEEQLENLIEFIRSRL

SEQ ID NO: 845473 - protein, 192 aa, Homo sapiens; identical to SEQ ID NO: 845472

SEQ ID NO: 845474 - protein, 192 aa, Homo sapiens; identical to SEQ ID NO: 845472

SEQ ID NO: 845475 - protein, 117 aa, Homo sapiens
MIRWGEEKRQADPGFFCRKIVEGISQPIWLVSDTRRVSDIQWFREAYGAVTQTVRVVALEQSRQQRGWVFTPGVDDAESECGLDNFGDFDWVIENHGVEQRLEEQLENLIEFIRSRL

SEQ ID NO: 845476 - protein, 134 aa, Homo sapiens
MAPMCKVILRICRGVFRGIEVEAPVLQGNLNSSKSGNAYEVKRGLWDHNLEDRDRLHSSLPPAPVGSRLCQCPLGAPHHSQLLQLWPVLLPARVLLNSQFNVSSSFSSCGVLLLFFCFCLVSDYFLIIKRDVSK

SEQ ID NO: 845477 - protein, 117 aa, Homo sapiens
VENFPGKHLEKWIGRVVTWQFSARPTLPSNDFFYVNRTATLLISGFLFFRNGDGMKKVFLMSRAIVCSALSSPLKRISLIIMKTFYLKRYYMLMELSFNKCFISVPIKHIVEIKDMK

SEQ ID NO: 845478 - protein, 99 aa, Homo sapiens
QGRCGGVGSTSRALPGCEVWLGYGPRAAAAAAATVLFGGAGPTETMFVARSIAADHKDLIHDVSFDFHGRRMATCSSDQSVKVWDKSESGDWHCTASWK

SEQ ID NO: 845479 - protein, 215 aa, Homo sapiens
MRFCPYSHRTRLVLKAKDIRHEVVNINLRNKPEWYYTKHPFGHIPVLETSQCQLIYESVIACEYLDDAYPGRKLFPYDPYERARQKMLLELFCKVPHLTKECLVALRCGRECTNLKAALRQEFSNLEEILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 845480 - protein, 181 aa, Homo sapiens
MRFCPYSHRTRLVLKAKDIRHEVVNINLRNKPEWYYTKHPFGHIPVLETSQCQLIYESVIACEYLDDAYPGRKLFPYDPYERARQKMLLELFCKILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 845481 - protein, 243 aa, Homo sapiens
MSGDATRTLGKGSQPPGPVPEGLIRIYSMRFCPYSHRTRLVLKAKDIRHEVVNINLRNKPEWYYTKHPFGHIPVLETSQCQLIYESVIACEYLDDAYPGRKLFPYDPYERARQKMLLELFCKVPHLTKECLVALRCGRECTNLKAALRQEFSNLEEILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 845482 - protein, 243 aa, Homo sapiens; identical to SEQ ID NO: 845481

SEQ ID NO: 845483 - protein, 1266 aa, Homo sapiens
THAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSVLPKAAFFMIILIDHLLQRTCEKPTSLKTAQSSWVNLPRPLPKSKASLKSPALRRTGSTPSIASTHSELSTYSNNSGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 845484 - protein, 532 aa, Homo sapiens
SASLLPERLKELRGSASKTTTTSGRNISKPDSCGLRQIAAPKAKVGPPVSCLRRNSDNRNPSADRAVSPQRIRRVSSSAGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 845485 - protein, 342 aa, Homo sapiens
MGCPSSKLCLYSPCAATRREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 845486 - protein, 211 aa, Homo sapiens [sequence omitted]

SEQ ID NO: 845487 - protein, 159 aa, Homo sapiens
LEDPTSYPRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 845488 - protein, 1245 aa, Homo sapiens
THAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSGKPTSLKTAQSSWVNLPRPLPKSKASLKSPALRRTGSTPSIASTHSELSTYSNNSGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 845489 - protein, 839 aa, Homo sapiens
THAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSGKPTSLKTAQSSWVNLPRPLPKSKASLKSPALRRTGSTPSIASTHSELSTYSNNSGNAAVIKYEEKPPKPAFQNGSSGSFYLKPLVSRAHVHLMKTPPKGPS

SEQ ID NO: 845490 - protein, 1090 aa, Homo sapiens
THAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSGKPTSLKTAQSSWVNLPRPLPKSKASLKSPALRRTGSTPSIASTHSELSTYSNNSGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINAIGTETMFESLITCS

SEQ ID NO: 845491 - protein, 1245 aa, Homo sapiens; identical to SEQ ID NO: 845488

SEQ ID NO: 845492 - protein, 436 aa, Homo sapiens
MLLSPKFSLSTIHIRLTAKGLLRNLRLPSGFRRSTVVFHTVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 845493 - protein, 240 aa, Homo sapiens [sequence omitted]

SEQ ID NO: 845494 - protein, 1245 aa, Homo sapiens; identical to SEQ ID NO: 845488

SEQ ID NO: 845495 - protein, 72 aa, Homo sapiens
VGGEQEVIWNIAIRIEKGSLSEFDEMCEIKTHKAVLSNRVGSGYVLILQENTDYHLKVSLNVTEESKNFPIL

SEQ ID NO: 845496 - protein, 359 aa, Homo sapiens
LLCYDCVGESSIKTHLCASLRHIRFLLSVCLLCLVAGTAVAVKMASTSRLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIARKAVELDLVPGRSPISVAAAAIYMASQASAEKRTQKEIGDIAGVADVTIRQSYRLIYPRAPDLFPTDFKFDTPVDKLPQL

SEQ ID NO: 845497 - protein, 359 aa, Homo sapiens; identical to SEQ ID NO: 845496

SEQ ID NO: 845498 - protein, 317 aa, Homo sapiens
ALLRLRGLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIARKAVELDLVPGRSPISVAAAAIYMASQASAEKRTQKEIGDIAGVADVTIRQSYRLIYPRAPDLFPTDFKFDTPVDKLPQL

SEQ ID NO: 845499 - protein, 341 aa, Homo sapiens
LLCYDCVGESSIKTHLCASLRHIRFLLSVCLLCLVAGTAVAVKMASTSRLDALPRVTCPNHPDAILVEDYRAGDMICPECGLVVGDRVIDVGSEWRTFSNDKATLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIARKAVELDLVPGRSPISVAAAAIYMASQASAEKRTQKEIGDIAGVADVTIRQSYRLIYPRAPDLFPTDFKFDTPVDKLPQL

SEQ ID NO: 845500 - protein, 316 aa, Homo sapiens
LLCYDCVGESSIKTHLCASLRHIRFLLSVCLLCLVAGTAVAVKMASTSRLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIARKAVELDLVPGRSPISVAAAAIYMASQASAEKRTQKD

SEQ ID NO: 845501 - protein, 437 aa, Homo sapiens
GIPLFIVRVLSLGGLPPLTGFLPKWAIIEEFTKNNSLIIPTIIATITLLNLYFYLRLIYSTSITLLPISNNVKIKDSLTYKTHPIPPHTHRPYHATPTYLPFYTNKVCLLCLVAGTAVAVKMASTSRLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIARKAVELDLVPGRSPISVAAAAIYMASQASAEKRTQKEIGDIAGVADVTIRQSYRLIYPRAPDLFPTDFKFDTPVDKLPQL

SEQ ID NO: 845502 - protein, 285 aa, Homo sapiens
MICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIARKAVELDLVPGRSPISVAAAAIYMASQASAEKRTQKEIGDIAGVADVTIRQSYRLIYPRAPDLFPTDFKFDTPVDKLPQL

SEQ ID NO: 845503 - protein, 359 aa, Homo sapiens; identical to SEQ ID NO: 845496

SEQ ID NO: 845504 - protein, 226 aa, Homo sapiens
ALLRLRGLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRNWRYCWCC

SEQ ID NO: 845505 - protein, 1360 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845506 - protein, 1352 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845507 - protein, 1297 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845508 - protein, 1268 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845509 - protein, 1352 aa, Homo sapiens; identical to SEQ ID NO: 845506

SEQ ID NO: 845510 - protein, 1352 aa, Homo sapiens; identical to SEQ ID NO: 845506

SEQ ID NO: 845511 - protein, 1276 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845512 - protein, 538 aa, Homo sapiens
MKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845513 - protein, 292 aa, Homo sapiens
MLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845514 - protein, 136 aa, Homo sapiens
VAVKSQGPALTASQSVHEQPTKGLSGFQEALNVTSHRVEMPRQNSDPTSENPPLPTRIEKFDRSSWLRQEEDIPPKVIFTGVFFLITSITDDFYYHYSRPFVVVENVIMPKHFPFSCLFWSLFIPWLRLGIAIYHV

SEQ ID NO: 845515 - protein, 90 aa, Homo sapiens
IITANAAAIHAQAKKHVPFKYTHAAPAPLADRGAQQQRTAARGLEIRAGWAPGPGGPTRGGSGSGAVGLGWAGEAGPGLWRDTRMRTRVK

SEQ ID NO: 845516 - protein, 1360 aa, Homo sapiens; identical to SEQ ID NO: 845505

SEQ ID NO: 845517 - protein, 1323 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845518 - protein, 1352 aa, Homo sapiens; identical to SEQ ID NO: 845506

SEQ ID NO: 845519 - protein, 1331 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845520 - protein, 1305 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845521 - protein, 383 aa, Homo sapiens
MEMGLQKLSFKMSLTSLILFLKALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 845522 - protein, 1296 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVGRLTIPYLLQQLHPPNET

SEQ ID NO: 845523 - protein, 258 aa, Homo sapiens
DLIDTAFPLCLWLYVSFILLCLSPALDPFCRSWLVSGNGSHPMDSHSGEPALLPCGTCDMVFRSSALLATHTQRFCIGHPTQEMTFGAQASVATEPQRAAVVPQEHQGVPQEPQGLPDQQASRSALKRLTEEVELPTFPQGSKRLSVFPKPVDHTWDRFCPRRDRGSLLPPGAVAAAIPTGNAALDNRGPQGVRGALDTFRGAAQSPMSEAVGSPSERLRALFRTRARRVAEMEAQSRALQLRGEGEGDGGRGPRTSS

SEQ ID NO: 845524 - protein, 239 aa, Homo sapiens
DLIDTAFPLCLWLYVSFILLCLSPALDPFCRSWLVSGNGSHPMDSHSGEPALLPCGTCDMVFRSSALLATHTQRFCIGHPTQEMTFGAQASVATEPQRAAKLSRRLQVVACTRGGMSRLFGLEQEIRELQAEAGRTRGALEVLGARIQELQAEPGNPLSSRREAELYSPVQKANPGTLAAEIRALREAYIRDGGRDPGVLGQIWQLQVEASALELQRSQTRRGRAGATSGELPVVEAEN

SEQ ID NO: 845525 - protein, 117 aa, Homo sapiens
DLIDTAFPLCLWLYVSFILLCLSPALDPFCRSWLVSGNGSHPMDSHSGEPALLPCGTCDMVFRSSALLATHTQRFCIGHPTQEMTFGAQASVATEPQRAAVRASMAMGGDSKEPGPL

SEQ ID NO: 845526 - protein, 779 aa, Homo sapiens
MSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSELNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 845527 - protein, 771 aa, Homo sapiens
MSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 845528 - protein, 565 aa, Homo sapiens
MGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 845529 - protein, 578 aa, Homo sapiens
AGARESCGGSSKGDGLPDGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 845530 - protein, 456 aa, Homo sapiens
MSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSELNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFHSTTTSARRSCTTSV

SEQ ID NO: 845531 - protein, 456 aa, Homo sapiens; identical to SEQ ID NO: 845530

SEQ ID NO: 845532 - protein, 289 aa, Homo sapiens
SGCGAARWCTGNAGVGDRRLSQFWWRRAHASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 845533 - protein, 431 aa, Homo sapiens
MSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSELNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKLPAAFPHRRSSKVTRQGSPYSL

SEQ ID NO: 845534 - protein, 811 aa, Homo sapiens
MSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSELNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 845535 - protein, 837 aa, Homo sapiens
MSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSELNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEVRGTAAGIMGARWGAELQSPPAPPFQFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 845536 - protein, 811 aa, Homo sapiens; identical to SEQ ID NO: 845534

SEQ ID NO: 845537 - protein, 856 aa, Homo sapiens
MSQGRTISQAPARRERPRKDPLRHLRTREKRGPSGCSGGPNTVYLQVVAAGSRDSGAALYVFSEFNRSVNEPRPVPLGPQCGAALSIGAPPRASASLLHTCGSLLRGFVELWYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSELNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 845538 - protein, 456 aa, Homo sapiens; identical to SEQ ID NO: 845530

SEQ ID NO: 845539 - protein, 565 aa, Homo sapiens
MLFPSLTAAMMGAMAAVPTGRSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 845540 - protein, 484 aa, Homo sapiens [sequence omitted]

SEQ ID NO: 845541 - protein, 129 aa, Homo sapiens
MSQGRTISQAPARRERPRKDPLRHLRTREKRGPSGCSGGPNTVYLQVVAAGSRDSGAALYVFSEFNRSVNEPRPVPLGPQCGAASEHRGTSQGFGFPASHMWFTVAGVRGVMVGGKSEILCIHVISADL

SEQ ID NO: 845542 - protein, 174 aa, Homo sapiens
MGIFVKTIFPNGSAAEDGRLKEGDEILDVNGIPIKGLTFQEAIHTFKQIRSGLFVLTVRTKLVSPSLTPCSTPTHMSRSASPNFNTSGGASAGGSDEGSSSSLGRKTPGPKDRIVMEVTLNKGDSSYSLPLSHFLNNILESVVSLILPCCSMNYSFGTIFYQQHVVSAWDSEVR

SEQ ID NO: 845543 - protein, 2125 aa, Homo sapiens
MSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPPGPVRLVIGRHPESKGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKLCQESLGKLTTGDACVSTSCELASALSHLDASHLTENLPKAASELGQQPMTSSDLISSPGKKGAAHPDPSKTSVDTGQVSRPENPSQPASPRVAKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEADVCFIVLNRKEGSGLGFSVAGGTDVEPKSITVHRVFSQGAASQEGTMNRGDFLLSVNGASLAGLAHGNVLKVLHQAQLHKDALVVIKKGMDQPRPSARQEPPTANGKGLLSRKTIPLEPGIGRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 845544 - protein, 2506 aa, Homo sapiens
MLRRFKHKAHSTYNGNSSNSSEPGETPTLELGDRTAKKGKRTRKFGVISRPPANKAPEESKGSAGCEVSSDPSTELENGPDPELGNGHVFQLENGPDSLKEVAGPHLERSEVDRGTEHRIPKTDAPLTTSNDKRRFSKGGKTDFQSSDCLARQEEVGRIWKMELLKESDGLGIQVSGGRGSKRSPHAIVVTQVKEGGASSQEYHIVKKSTRSLSTTQVESPWRLIRPSVISIIGLYKEKGKGLGFSIAGGRDCIRGQMGIFVKTIFPNGSAAEDGRLKEGDEILDVNGIPIKGLTFQEAIHTFKVTTFLLISFILFSFLISFWLGFGELFFFFNPLYKDIPNVSAHLSSLFSQQIRSGLFVLTVRTKLVSPSLTPCSTPTHMSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPPGPVRLVIGRHPESKGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKLCQESLGKLTTGDACVSTSCELASALSHLDASHLTENLPKAASELGQQPMTSSDLISSPGKKGAAHPDPSKTSVDTGQVSRPENPSQPASPRVAKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEADVCFIVLNRKEGSGLGFSVAGGTDVEPKSITVHRVFSQGAASQEGTMNRGDFLLSVNGASLAGLAHGNVLKVLHQAQLHKDALVVIKKGMDQPRPSARQEPPTANGKGLLSRKTIPLEPGIGRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 845545 - protein, 1507 aa, Homo sapiens
MTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEADVCFIVLNRKEGSGLGFSVAGGTDVEPKSITVHRVFSQGAASQEGTMNRGDFLLSVNGASLAGLAHGNVLKVLHQAQLHKDALVVIKKGMDQPRPSARQEPPTANGKGLLSRKTIPLEPGIGRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 845546 - protein, 2159 aa, Homo sapiens
MSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPPGPVRLVIGRHPESKGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKLCQESLGKLTTGDACVSTSCELASALSHLDASHLTENLPKAASELGQQPMTSSDLISSPGKKGAAHPDPSKTSVDTGQVSRPENPSQPASPRVAKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEADVCFIVLNRKEGSGLGFSVAGGTDVEPKSITVHRVFSQGAASQEGTMNRGDFLLSVNGASLAGLAHGNVLKVLHQAQLHKDALVVIKKGMDQPRPSARQEPPTANGKGLLSRKTIPLEPGIENTEQRMQVQQQHSQEGSPRIGRPTVLLGSSAVIRRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 845547 - protein, 209 aa, Homo sapiens
MNRGDFLLSVNGASLAGLAHGNVLKVLHQAQLHKDALVVIKKGMDQPRPSARQEPPTANGKGLLSRKTIPLEPGIENTEQRMQVQQQHSQEGSPRIGRPTVLLGSSAVIRRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 845548 - protein, 2159 aa, Homo sapiens; identical to SEQ ID NO: 845546

SEQ ID NO: 845549 - protein, 1985 aa, Homo sapiens
MSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPPGPVRLVIGRHPESKGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKLCQESLGKLTTGDACVSTSCELASALSHLDASHLTENLPKAASELGQQPMTSSDLISSPGKKGAAHPDPSKTSVDTGQVSRPENPSQPASPRVAKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEADVCFIVLNRKEGSGLGFSVAGGTDVEPKSITVHRVFSQGAASQEGTMNRGDFLLSVNGASLAGLAHGNVLKVLHQAQLQGL

SEQ ID NO: 845550 - protein, 159 aa, Homo sapiens [sequence omitted]

SEQ ID NO: 845551 - protein, 2643 aa, Homo sapiens
MPITQDNAVLHLPLLYQWLQNSLQEGGDGPEQRLCQAAIQKLQEYIQLNFAVDESTVPPDHSPPEMEICTVYLTKELGDTETVGLSFGNIPVFGDYGEKRRGGKKRKTHQGPVLDVGCIWVTELRKNSPAGKSGKVRLRDEILSLNGQLMVGVDVSGASYLAEQCWNGGFIYLIMLRRFKHKAHSTYNGNSSNSSEPGETPTLELGDRTAKKGKRTRKFGVISRPPANKAPEESKGSAGCEVSSDPSTELENGPDPELGNGHVFQLENGPDSLKEVAGPHLERSEVDRGTEHRIPKTDAPLTTSNDKRRFSKGGKTDFQSSDCLARQEEVGRIWKMELLKESDGLGIQVSGGRGSKRSPHAIVVTQVKEGGASSQEYHIVKKSTRSLSTTQVESPWRLIRPSVISIIGLYKEKGKGLGFSIAGGRDCIRGQMGIFVKTIFPNGSAAEDGRLKEGDEILDVNGIPIKGLTFQEAIHTFKQIRSGLFVLTVRTKLVSPSLTPCSTPTHMSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPVSEQEMDEVIARSTYQESKEANSSPGLGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARGKPPLQEIQAEAKPSGSQTVNLTGRANDPCDLDSRVQATSVKVTVAGFQPGGAVEKLCQESLGKLTTGDACVSTSCELASALSHLDASHLTENLPKAASELGQQPMTSSDLISSPGKKGAAHPDPSKTSVDTGQVSRPENPSQPASPRVAKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEADVCFIVLNRKEGSGLGFSVAGGTDVEPKSITVHRVFSQGAASQEGTMNRGDFLLSVNGASLAGLAHGNVLKVLHQAQLHKDALVVIKKGMDQPRPSARQEPPTANGKGLLSRKTIPLEPGIGRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 845552 - protein, 2200 aa, Homo sapiens
MGIFVKTIFPNGSAAEDGRLKEGDEILDVNGIPIKGLTFQEAIHTFKQIRSGLFVLTVRTKLVSPSLTPCSTPTHMSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPPGPVRLVIGRHPESKGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARGKPPLQEIQAEAKPSGSQTVNLTGRANDPCDLDSRVQATSVKVTVAGFQPGGAVEKLCQESLGKLTTGDACVSTSCELASALSHLDASHLTENLPKAASELGQQPMTSSDLISSPGKKGAAHPDPSKTSVDTGQVSRPENPSQPASPRVAKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEADVCFIVLNRKEGSGLGFSVAGGTDVEPKSITVHRVFSQGAASQEGTMNRGDFLLSVNGASLAGLAHGNVLKVLHQAQLHKDALVVIKKGMDQPRPSARQEPPTANGKGLLSRKTIPLEPGIGRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 845553 - protein, 2159 aa, Homo sapiens; identical to SEQ ID NO: 845546

SEQ ID NO: 845554 - protein, 1984 aa, Homo sapiens
MSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPPGPVRLVIGRHPESKGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKLCQESLGKLTTGDACVSTSCELASALSHLDASHLTENLPKAASELGQQPMTSSDLISSPGKKGAAHPDPSKTSVDTGQVSRPENPSQPASPRVAKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEADVCFIVLNRKEGSGLGFSVAGGTDVEPKSITVSDRVIRLSGKSPLKQPQNVIRAQIPISGFRDCWISFPATNIKREKWEK

SEQ ID NO: 845555 - protein, 538 aa, Homo sapiens
MSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPPGPVRLVIGRHPESKGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKLCQESLGKLTTGDACVSTSCELASALSHLDASHLTENLPKAASELGQQPMTGSSTPDITWRGCWAFHPTDVL

SEQ ID NO: 845556 - protein, 495 aa, Homo sapiens
MPITQDNAVLHLPLLYQWLQNSLQEGGDGPEQRLCQAAIQKLQEYIQLNFAVDESTVPPDHSPPEMEICTVYLTKELGDTETVGLSFGNIPVFGDYGEKRRGGKKRKTHQGPVLDVGCIWVTELRKNSPAGKSGKVRLRDEILSLNGQLMVGVDVSGASYLAEQCWNGGFIYLIMLRRFKHKAHSTYNGNSSNSSEPGETPTLELGDRTAKKGKRTRKFGVISRPPANKAPEESKGSAGCEVSSDPSTELENGPDPELGNGHVFQLENGPDSLKEVAGPHLERSEVDRGTEHRIPKTDAPLTTSNDKRRFSKGGKTDFQSSDCLARQEEVGRIWKMELLKESDGLGIQVSGGRGSKRSPHAIVVTQVKEGGAAHRDGRLSLGDELLVINGHLLVGLSHEEAVAILRSATGMVQLVVASKENSAEDLLRLTSKSLPDLTSSVEDVSSWTDNEDQEADGEEDEGTSSSVQRAMPGTDEPQDVCGAEESKGNLESPKQ

SEQ ID NO: 845557 - protein, 86 aa, Homo sapiens
QISLTGGCTKAQLFSVNGCQLPTTSHTDGSHLNVCEISCPSFSIPSRHPLPMTDGYRDTKAQTPIFQEEKTLWWCHLCSRATAGSS

SEQ ID NO: 845558 - protein, 1297 aa, Homo sapiens
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 845559 - protein, 1223 aa, Homo sapiens
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 845560 - protein, 1102 aa, Homo sapiens
FDSCGSAAAVSPLSSDVVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 845561 - protein, 1405 aa, Homo sapiens
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKVSAACRAWGLLALDRCQGGARRSCAHHCPERHLPGTQLRPGKKKGFRCKDLVASEMGDLIEVAFQGYRSSLAPPKAEDEGRLWGLSSLGQGQKGNPTLLADSVSLGKQKAKGDVKKKGRPDPYAYIPLNRSKLNRRKKMKLQGQFKGLVKAARRGSQVGHKNRRKDRRP

SEQ ID NO: 845562 - protein, 1221 aa, Homo sapiens
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGLRMTWN

SEQ ID NO: 845563 - protein, 1268 aa, Homo sapiens
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAPKQAKPQKKISCKDSCRSWTHDDLALRPWS

SEQ ID NO: 845564 - protein, 782 aa, Homo sapiens
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLEC

SEQ ID NO: 845565 - protein, 1044 aa, Homo sapiens
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGILTWGKKAVGPKEYPKSLQNFRKNRPGP

SEQ ID NO: 845566 - protein, 139 aa, Homo sapiens
FLWWGAQGGVTVALTVPPPWQGSGGGPDVQIPCGLELRVAAAVCLLRGVWETGPPCDEEGEWGAAGARAGSGAGSWTMGSWRARVSVISAPCSAPHPDRAIAGAPCSIPWKVTGPTREGQEKGWQSPHLLTSLCWSYWF

SEQ ID NO: 845567 - protein, 1197 aa, Homo sapiens
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 845568 - protein, 1130 aa, Homo sapiens
PPYQLRRPNTVRWPNTVRLPNVGQRTFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 845569 - protein, 415 aa, Homo sapiens
MDSLRALRLGANQEKALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 845570 - protein, 1253 aa, Homo sapiens
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKPALPVQPT

SEQ ID NO: 845571 - protein, 1198 aa, Homo sapiens
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGGPNALVHSFTVFTYSFGDHLLRKRG

SEQ ID NO: 845572 - protein, 31 aa, Homo sapiens
MEEEAELVLTEKSSGTFLSGLSDCTNVTFSK

SEQ ID NO: 845573 - protein, 71 aa, Homo sapiens
AALQGPSGVTISVLSHSVPSPVLIKKFSDTSKAFMDIMSAQASSGSTSVLRWVSVWGLVSHLATPRACLIW

SEQ ID NO: 845574 - protein, 227 aa, Homo sapiens
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQSSFQTTVPLHPVQGSPLETPRSSAKQCSLEVKVLVAEPLLTTAQISGGNLLKVTLEAAYSVPESFIPTGPGQNYMVGLQVPSLGEKDYPILFKNGTLKLGGEREPVPRP

SEQ ID NO: 845575 - protein, 133 aa, Homo sapiens [sequence omitted]

SEQ ID NO: 845576 - protein, 82 aa, Homo sapiens
RRHIHDPRHRSNLCLTPPLPARDGKQTESGSSECSLEGLLENLLEGCEDMFGNLFAENIFSPVHHSQLAEELKRQEISKRER

SEQ ID NO: 845577 - protein, 169 aa, Homo sapiens
MILLEVNNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKQGQSHSSLQHSV

SEQ ID NO: 845578 - protein, 152 aa, Homo sapiens
GGSGLGGRNKPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKQGQSHSSLQHSV

SEQ ID NO: 845579 - protein, 65 aa, Homo sapiens
MIEDPIEICKCYFYCFRFVSGGRVLELERERLLDDAVVHLQQDHGGGWPPKPDPPHDLPPAATAA

SEQ ID NO: 845580 - protein, 169 aa, Homo sapiens; identical to SEQ ID NO: 845577

SEQ ID NO: 845581 - protein, 169 aa, Homo sapiens; identical to SEQ ID NO: 845577

SEQ ID NO: 845582 - protein, 169 aa, Homo sapiens; identical to SEQ ID NO: 845577

SEQ ID NO: 845583 - protein, 169 aa, Homo sapiens; identical to SEQ ID NO: 845577

SEQ ID NO: 845584 - protein, 150 aa, Homo sapiens
RSLRRRAQPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKQGQSHSSLQHSV

SEQ ID NO: 845585 - protein, 152 aa, Homo sapiens; identical to SEQ ID NO: 845578

SEQ ID NO: 845586 - protein, 169 aa, Homo sapiens; identical to SEQ ID NO: 845577

SEQ ID NO: 845587 - protein, 169 aa, Homo sapiens; identical to SEQ ID NO: 845577

SEQ ID NO: 845588 - protein, 104 aa, Homo sapiens
MILLEVNNRIIEETLALKFENAAAGNKPEAVEVTFADFDGVLYHISNPNGDKTKVMVSISLKFYKELQAHGADELLKRVYGSFLVNPESGSLLIGCLNIHGQRN

SEQ ID NO: 845589 - protein, 104 aa, Homo sapiens
MFDLIEAGNFVSTLFEWLLTTEVLKFFFFFLIVSLLLPKRECSGAILAHRNLRLSWVQVILLPKPPGSQQSSNRLSQHSWPEELKGTVSSLNRTAMLYCFKKEV

SEQ ID NO: 845590 - protein, 195 aa, Homo sapiens
DDKARYSWCESPRLSVKRQWRRPAAAMILLEVNNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKQGQSHSSLQHSV

SEQ ID NO: 845591 - protein, 177 aa, Homo sapiens
SGRSSLRLGTRPGCYNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKQGQSHSSLQHSV

SEQ ID NO: 845592 - protein, 147 aa, Homo sapiens
MYEAGVNLAEGTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKQGQSHSSLQHSV

SEQ ID NO: 845593 - protein, 104 aa, Homo sapiens; identical to SEQ ID NO: 845588

SEQ ID NO: 845594 - protein, 104 aa, Homo sapiens; identical to SEQ ID NO: 845588

SEQ ID NO: 845595 - protein, 137 aa, Homo sapiens
MIEDPIEICKCYFYCFRFVSGGRVLELERERLLDDAVVHLQQDHGGGWPQGKEKQGPVRVGKGGKDGGRGLCMLSLNKDRVTVVFSTVFKDDDDVVIGKVFMQEFKEGRRASHTAPQVLFSHREPPLELKDTDAAVG

SEQ ID NO: 845596 - protein, 137 aa, Homo sapiens; identical to SEQ ID NO: 845595

SEQ ID NO: 845597 - protein, 179 aa, Homo sapiens
MILLEVNNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLSLNKDRVTVVFSTVFKDDDDVVIGKVFMQEFKEGRRASHTAPQVLFSHREPPLELKDTDAAVG

SEQ ID NO: 845598 - protein, 137 aa, Homo sapiens; identical to SEQ ID NO: 845595

SEQ ID NO: 845599 - protein, 75 aa, Homo sapiens
LSSWILFLSGMLSLNKDRVTVVFSTVFKDDDDVVIGKVFMQEFKEGRRASHTAPQVLFSHREPPLELKDTDAAVG

SEQ ID NO: 845600 - protein, 169 aa, Homo sapiens; identical to SEQ ID NO: 845577

SEQ ID NO: 845601 - protein, 169 aa, Homo sapiens; identical to SEQ ID NO: 845577

SEQ ID NO: 845602 - protein, 169 aa, Homo sapiens; identical to SEQ ID NO: 845577

SEQ ID NO: 845603 - protein, 110 aa, Homo sapiens
GKAEPLREAGAGRWTVEGFFEHWHWCDEGQHKGNVPMLSPTAASVSFSSRGGSLWLKRTCGAVWLALRPSLNSCMNTFPMTTSSSSLNTVLKTTVTLSFLDSTYMVSSSL

SEQ ID NO: 845604 - protein, 112 aa, Homo sapiens
MILLEVNNRIIEETLALKFENAAAGNKPEAVEVTFADFDGVLYHISNPNGDKTKVMVSISLKFYKELQAHGADEVRSTSFSLGLLFPHLSLAVCHSWKIHGTKSPPHDYLLT

SEQ ID NO: 845605 - protein, 104 aa, Homo sapiens; identical to SEQ ID NO: 845588

SEQ ID NO: 845606 - protein, 104 aa, Homo sapiens
GAAGPRVQAASGSGCESGSGRLEPGAGRGPGLSVKRQWRRRRRLGRRVQASGASRRHDPAGGEQPHHRGDARAQVRERGRRKQTGSSRSNICRFRWGPLSYFKS

SEQ ID NO: 845607 - protein, 104 aa, Homo sapiens; identical to SEQ ID NO: 845588

SEQ ID NO: 845608 - protein, 108 aa, Homo sapiens
MILLEVNNRIIEETLALKFENAAAGNKPEAVEVTFADFDGVLYHISNPNGDKTKVMVSISLKFYKELQAHGADEPPPLFFFFFFFFFFFGHLKAFILCKKLKYDYGVT

SEQ ID NO: 845609 - protein, 106 aa, Homo sapiens
VCVVLLRSSWYDCVFSLAPIYACVLSRAPFSPPSCFFERCRAVVQVSTVRCSSGFLCLMAPLSLLLPSECPALCQRFSFVSRDSGVKRFPRDGSISFSGFGFPFSP

SEQ ID NO: 845610 - protein, 166 aa, Homo sapiens
MILLEVNNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMVVIGKVFMEFKEGS

SEQ ID NO: 845611 - protein, 169 aa, Homo sapiens; identical to SEQ ID NO: 845577

SEQ ID NO: 845612 - protein, 169 aa, Homo sapiens; identical to SEQ ID NO: 845577

SEQ ID NO: 845613 - protein, 169 aa, Homo sapiens; identical to SEQ ID NO: 845577

SEQ ID NO: 845614 - protein, 169 aa, Homo sapiens; identical to SEQ ID NO: 845577

SEQ ID NO: 845615 - protein, 169 aa, Homo sapiens; identical to SEQ ID NO: 845577

SEQ ID NO: 845616 - protein, 159 aa, Homo sapiens
HRGSPSRFIPHLINLIPFLYLPSHHFPFLPPSFPSCFACNILLVMSCSISLKFYKELQAHGADELLKRVYGSFLVNPESGYNVSLLYDLENLPASKDSIVHQAGMLKRNCFASVFEKYFQFQEEGKEGENRAVIHYRDDETMYVESKQGQSHSSLQHSV

SEQ ID NO: 845617 - protein, 169 aa, Homo sapiens; identical to SEQ ID NO: 845577

SEQ ID NO: 845618 - protein, 169 aa, Homo sapiens; identical to SEQ ID NO: 845577

SEQ ID NO: 845619 - protein, 104 aa, Homo sapiens; identical to SEQ ID NO: 845588

SEQ ID NO: 845620 - protein, 114 aa, Homo sapiens
MVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKQGQSHSSLQHSV

SEQ ID NO: 845621 - protein, 86 aa, Homo sapiens
DDKARYSWCESPRLSVKRQWRRRRRLGRRVQASGASRRHDPAGGEQPHHRGDARAQVRERGRRKQTGSSRSNICRFRWGPLSYFKS

SEQ ID NO: 845622 - protein, 137 aa, Homo sapiens; identical to SEQ ID NO: 845595

SEQ ID NO: 845623 - protein, 104 aa, Homo sapiens; identical to SEQ ID NO: 845588

SEQ ID NO: 845624 - protein, 77 aa, Homo sapiens
SRGIAAGMMRPCMLSLNKDRVTVVFSTVFKDDDDVVIGKVFMQEFKEGRRASHTAPQVLFSHREPPLELKDTDAAVG

SEQ ID NO: 845625 - protein, 169 aa, Homo sapiens; identical to SEQ ID NO: 845577

SEQ ID NO: 845626 - protein, 104 aa, Homo sapiens; identical to SEQ ID NO: 845588

SEQ ID NO: 845627 - protein, 139 aa, Homo sapiens
MILLEVNNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLKHSSLLLFSSCKQLKIFKIKFTL

SEQ ID NO: 845628 - protein, 86 aa, Homo sapiens; identical to SEQ ID NO: 845621

SEQ ID NO: 845629 - protein, 589 aa, Homo sapiens
LGEGAQVAAILDCELGRYASRQGGVAALLLPATHVAAGDWEIRASESATLMDAMASPGKDNYRMKSYKNKALNPQEMRRRREEEGIQLRKQKREEQLFKRRNVYLPRNDESMLESPIQDPDISSTVPIPEEEVVTTDMVQMIFSNNADQQLTATQKFRKLLSKEPNPPIDQVIQKPGVVQRFVKFLERNENCTLQFEAAWALTNIASGTFLHTKVVIETGAVPIFIKLLNSEHEDVQEQAVWALGNIAGDNAECRDFVLNCEILPPLLELLTNSNRLTTTRNAVWALSNLCRGKNPPPNFSKVSPCLNVLSRLLFSSDPDVLADVCWALSYLSDGPNDKIQAVIDSGVCRRLVELLMHNDYKVVSPALRAVGNIVTGDDIQTQVILNCSALPCLLHLLSSPKESIRKEACWTVSNITAGNRAQIQAVIDANIFPVLIEILQKAEFRTRKEAAWAITNATSGGTPEQIRYLVALGCIKPLCDLLTVMDSKIVQVALNGLENILRLGEQESKQNGIGINPYCALIEEAYGLDKIEFLQSHENQEIYQKAFDLIEHYFGVEEDDPSIVPQVDENQQQFIFQQQEAPMDGFQL

SEQ ID NO: 845630 - protein, 589 aa, Homo sapiens; identical to SEQ ID NO: 845629

SEQ ID NO: 845631 - protein, 536 aa, Homo sapiens
MASPGKDNYRMKSYKNKALNPQEMRRRREEEGIQLRKQKREEQLFKRRNVYLPRNDESMLESPIQDPDISSTVPIPEEEVVTTDMVQMIFSNNADQQLTATQKFRKLLSKEPNPPIDQVIQKPGVVQRFVKFLERNENCTLQFEAAWALTNIASGTFLHTKVVIETGAVPIFIKLLNSEHEDVQEQAVWALGNIAGDNAECRDFVLNCEILPPLLELLTNSNRLTTTRNAVWALSNLCRGKNPPPNFSKVSPCLNVLSRLLFSSDPDVLADVCWALSYLSDGPNDKIQAVIDSGVCRRLVELLMHNDYKVVSPALRAVGNIVTGDDIQTQVILNCSALPCLLHLLSSPKESIRKEACWTVSNITAGNRAQIQAVIDANIFPVLIEILQKAEFRTRKEAAWAITNATSGGTPEQIRYLVALGCIKPLCDLLTVMDSKIVQVALNGLENILRLGEQESKQNGIGINPYCALIEEAYGLDKIEFLQSHENQEIYQKAFDLIEHYFGVEEDDPSIVPQVDENQQQFIFQQQEAPMDGFQL

SEQ ID NO: 845632 - protein, 199 aa, Homo sapiens
MIVSSDSNNIDITCTKLSYYSRNFSEGISKKEDNIKKKLQIMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 845633 - protein, 314 aa, Homo sapiens
MQNVINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 845634 - protein, 314 aa, Homo sapiens; identical to SEQ ID NO: 845633

SEQ ID NO: 845635 - protein, 311 aa, Homo sapiens
MQNVINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYPSLYVRLVAKWLLTIFFLRNLV

SEQ ID NO: 845636 - protein, 314 aa, Homo sapiens; identical to SEQ ID NO: 845633

SEQ ID NO: 845637 - protein, 306 aa, Homo sapiens
MQNVINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLISLKCSTNCAWDRYR

SEQ ID NO: 845638 - protein, 262 aa, Homo sapiens
MAWATGEELKVKAYLPTGKQFLVTKNVPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 845639 - protein, 267 aa, Homo sapiens
ERTRHERAQAPPSNAQEKVVVQPLSLFFPATLPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 845640 - protein, 140 aa, Homo sapiens
VQCYASGRRGEAAYPAPARPLSHVTCRESLVSREAPVAAQLRQESEKEGKPEGARVKQSEDRQLPEGEGCVCVRFSPQVSLRPRCPPSRLGDSWVRSVAGCLGCEDRAPRLRALCLPPRPLVPPVPSRRVPSPRVLPAGC

SEQ ID NO: 845641 - protein, 103 aa, Homo sapiens
RASLLSCCILIIPPFQTLIQRQPLTVEHMYEDISQDHVKKTVTIENHPHLPPPPMCSVHPCRHAEVMKKIIETVAEGGGELGVHMYLLISLKCSTNCAWDRYR

SEQ ID NO: 845642 - protein, 314 aa, Homo sapiens; identical to SEQ ID NO: 845633

SEQ ID NO: 845643 - protein, 314 aa, Homo sapiens; identical to SEQ ID NO: 845633

SEQ ID NO: 845644 - protein, 319 aa, Homo sapiens
MQNVINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFWKLGQAVIPTKKDPHPTRGKGKKNII

SEQ ID NO: 845645 - protein, 227 aa, Homo sapiens
MEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 845646 - protein, 301 aa, Homo sapiens
MQNVINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAYITYDKYYQTPRLWLFGYDEQRQPLTVEHMYEDISQDHVKKTVTIENHPHLPPPPMCSVHPCRHAEVMKKIIETVAEGGGELGVHMYLLIFWKLGQAVIPTKKDPHPTRGKGKKNII

SEQ ID NO: 845647 - protein, 741 aa, Homo sapiens
SLIPILQFSLPLEPLNSSSYVLLFLLDNSSSLQEDEEVEMEAISWQASSPAMNGHPAPPVTSARFPSWVTFDDNEVSCPLPPVTSPLKPNTPPSASVIPDVPYNSMGSFKKRDRPKSTLMNFSKVQKLDISSLNRTPSVTEASPWRATNPFLNETLQDVQPSPINPFSAFFEEQERRSQNSSISSTTGKSQRDSLIVIYQDAISFDDSSKTQSHSDAVEKLKQLQIDDPDHFGSATLPDDDPVAWIELDAHPPGSARSQPRDGWPMMLRIPEKKNIMSSRHWGPIFVKLTDTGYLQLYYEQGLEKPFREFKLEICHEISEPRLQNYDENGRIHSLRIDRVTYKEKKKYQPKPAVAHTAEREQVIKLGTTNYDDFLSFIHAVQDRLMDLPVLSMDLSTVGLNYLEEEITVDVRDEFSGIVSKGDNQILQHHVLTRIHILSFLSGLAECRLGLNDILVKGNEIVLRQDIMPTTTTKWIKLHECRFHGCVDEDVFHNSRVILFNPLDACRFELMRFRTVFAEKTLPFTLRTATSVNGAEVEVQSWLRMSTGFSANRDPLTQVPCENVMIRYPVPSEWVKNFRRESVLGEKSLKAKVNRGASFGSTSVSGSEPVMRVTLGTAKYEHAFNSIVWRINRLPDKNSASGHPHCFFCHLELGSDREVPSRFANHVNVEFSMPTTSASKASVRSISVEDKTDVRKWVNYSAHYSYQVALGSIWLMLPTPFVHPTTLPLLFLLAMLTMFAW

SEQ ID NO: 845648 - protein, 905 aa, Homo sapiens [sequence omitted]

SEQ ID NO: 845649 - protein, 884 aa, Homo sapiens
MTTLDHVIATHQSEWVSFNEEPPFPAHSQGGTEEHLPGLSSSPDQSESSSGENHVVDGGSQDHSHSEQDDSSEKMGLISEAASPPGSPEQPPPDLASAISNWVQFEDDTPWASTSPPHQETAETALPLTMPCWTCPSFDSLGRCPLTSESSWTTHSEDTSSPSFGCSYTDLQLINAEEQTSGQASGADSTDNSSSLQEDEEVEMEAISWQASSPAMNGHPAPPVTSARFPSWVTFDDNEVSCPLPPVTSPLKPNTPPSASVIPDVPYNSMGSFKKRDRPKSTLMNFSKVQKLDISSLNRTPSVTEAPPWRATNPFLNETLQDVQPSPINPFSAFFEEQERRSQNSSISSTTGKSQRDSLIVIYQDAISFDDSSKTQSHSDAVEKLKQLQIDDPDHFGSATLPDDDPVAWIELDAHPPGSARSQPRDGWPMMLRIPEKKNIMSSRHWGPIFVKLTDTGYLQLYYEQGLEKPFREFKLEICHEISEPRLQNYDENGRIHSLRIDRVTYKEKKKYQPKPAVAHTAEREQVIKLGTTNYDDFLSFIHAVQDRLMDLPVLSMDLSTVGLNYLEEEITVDVRDEFSGIVSKGDNQILQHHVLTRIHILSFLSGLAECRLGLNDILVKGNEIVLRQDIMPTTTTKWIKLHECRFHGCVDEDVFHNSRVILFNPLDACRFELMRFRTVFAEKTLPFTLRTATSVNGAEVEVQSWLRMSTGFSANRDPLTQVPCENVMIRYPVPSEWVKNFRRESVLGEKSLKAKVNRGASFGSTSVSGSEPVMRVTLGTAKYEHAFNSIVWRINRLPDKNSASGHPHCFFCHLELGSDREVPSRFANHVNVEFSMPTTSASKASVRSISVEDKTDVRKWVNYSAHYSYQVEIEQKKEFEAGL

SEQ ID NO: 845650 - protein, 173 aa, Homo sapiens
AAFVQSCYWMPSLAPDCPLLAMPEETQEDSVAPMMPSQRSRGPLAPNHVHEVCLHQVESISDLHSGAGTLRPYLTEEARPWDELLGVLPPSLCAQAGCSPVYRRGGFLLLLALLVLTCLVLALLAVYLSVLQSESLRILAHTLRTQEETLLKLRLASLSQLRRLNSSEAQAPS

SEQ ID NO: 845651 - protein, 212 aa, Homo sapiens
RSLPLQTLEGRALYYRPWKQEDCIQPSSWLLAKVTIDGRNYIVDAGSGSSSQMWQPLELISGKDQPQVPCIFCLTEERGIWYLDQIRREQYITNKEFLNSHLLPKKKHQKIYLFTLEPRTIEDFESMNTYLQTSPTSSFITTSFCSLQTPEGVYCLVGFILTYRKFNYKDNTDLVEFKTLTEEEVEEVLKNIFKISLGRNLVPKPGDGSLTI

SEQ ID NO: 845652 - protein, 325 aa, Homo sapiens
RSLPLQTLEGRALYYRPWKQEDCIQPSSWLLAKGIMDIEAYFERIGYKNSRNKLDLETLTDILEHQIRAVPFENLNMHCGQAMELGLEAIFDHIVRRNRGGWCLQVNQLLYWALTTIGFQTTMLGGYFYIPPVNKYSTGMVHLLLQVTIDGRNYIVDAGSGSSSQMWQPLELISGKDQPQVPCIFCLTEERGIWYLDQIRREQYITNKEFLNSHLLPKKKHQKIYLFTLEPRTIEDFESMNTYLQTSPTSSFITTSFCSLQTPEGVYCLVGFILTYRKFNYKDNTDLVEFKTLTEEEVEEVLKNIFKISLGRNLVPKPGDGSLTI

SEQ ID NO: 845653 - protein, 298 aa, Homo sapiens
RSLPLQTLEGRALYYRPWKQEDCIQPSSWLLAKGIMDIEAYFERIGYKNSRNKLDLETLTDILEHQIRAVPFENLNMHCGQAMELGLEAIFDHIVRRNRGGWCLQVNQLLYWALTTIGFQTTMLGGYFYIPPVNKYSTGMVHLLLQVTIDGRNYIVDAGSGSSSQMWQPLELISGKDQPQVPCIFCLTEERGIWYLDQIRREQYITNKEFLNSHLLPKKKHQKKKKNWGGGRGPARKSFLKTIARGAAGGPQGVRGTGGQSGVPRGKPGAEEQDGAGNLSSTKLKTGRAGDHTREGLA

SEQ ID NO: 845654 - protein, 106 aa, Homo sapiens
GNIFLPLKIFSQDRSPRPRQVKRHNLAQLQARTLHIQRGYLRHAVAHATGSQRTCGGGGEGNAFGKQPSEVGSQKTRGKASRKITEGRSRPPERSELSVTRPRERG

SEQ ID NO: 845655 - protein, 101 aa, Homo sapiens
GGGGLPAETSGWRRPRLRPGFPPPEGRDKPDLLQALVGVGEERGSVRLVCGWEALVLQKPARAAILRELRWRRWREGRTLLGRGRGVPQYLYGSSLLPPVL

SEQ ID NO: 845656 - protein, 101 aa, Homo sapiens; identical to SEQ ID NO: 845655

SEQ ID NO: 845657 - protein, 101 aa, Homo sapiens; identical to SEQ ID NO: 845655

SEQ ID NO: 845658 - protein, 101 aa, Homo sapiens; identical to SEQ ID NO: 845655

SEQ ID NO: 845659 - protein, 101 aa, Homo sapiens; identical to SEQ ID NO: 845655

SEQ ID NO: 845660 - protein, 101 aa, Homo sapiens; identical to SEQ ID NO: 845655

SEQ ID NO: 845661 - protein, 101 aa, Homo sapiens; identical to SEQ ID NO: 845655

SEQ ID NO: 845662 - protein, 101 aa, Homo sapiens; identical to SEQ ID NO: 845655

SEQ ID NO: 845663 - protein, 101 aa, Homo sapiens; identical to SEQ ID NO: 845655

SEQ ID NO: 845664 - protein, 101 aa, Homo sapiens; identical to SEQ ID NO: 845655

SEQ ID NO: 845665 - protein, 101 aa, Homo sapiens; identical to SEQ ID NO: 845655

SEQ ID NO: 845666 - protein, 106 aa, Homo sapiens; identical to SEQ ID NO: 845654

SEQ ID NO: 845667 - protein, 137 aa, Homo sapiens
MGCSALKMKNKSRRMEETEVDSDTETIFGAFLCMRTSQQNLKQVMSVPDREPSTSFPCSPGQKPNPSLWLHSPVSRAPSTVQPPPGSLPSSHDSLRPSHICFSLFPNIKTLPVSGRCPWFYPTYPVTFSSFRSRLRA

SEQ ID NO: 845668 - protein, 562 aa, Homo sapiens
SHPQAMQWNSTAFHQALQDPRVRGLYFPAGGSSSGTVNPAQNIASHISSISSRTGDPAPNMENITSGFLGPLLVLQAGFFLLTRILTIPQSLDSWWTSLNFLGGSPVCLGQNSQSPTSNHSPTSCPPICPGYRWMCLRRFIIFLFILLLCLIFLLVLLDYQGFPGAMLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 845669 - protein, 506 aa, Homo sapiens
AVTSRRCDVPMATTPRFTAGVRVALPASHSPVPVFHALRAAALETGIQEPGGAEAPAQAKTAPQAKTAPQAAHSHEPGCLTGPDPARFPSSPRGDSTHSWPRHRSGFPGAMLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 845670 - protein, 601 aa, Homo sapiens
SHPQAMQWNSTAFHQALQDPRVRGLYFPAGGSSSGTVNPAQNIASHISSISSRTGDPAPNMENITSGFLGPLLVLQAGFFLLTRILTIPQSLDSWWTSLNFLGGSPVCLGQNSQSPTSNHSPTSCPPICPGYRWMCLRRFIIFLFILLLCLIFLLVLLDYQGFPGAMLSEVLLVSAPGKVILHGEHAVVHGKVALAVSLNLRTFLRLQPHSNGKVDLSLPNIGIKRAWDVARLQSLDTSFLGSHSVMQPGVQWCDHSSLFLQPPGLKRSSCLSLLRAGTTEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 845671 - protein, 439 aa, Homo sapiens
SHPQAMQWNSTAFHQALQDPRVRGLYFPAGGSSSGTVNPAQNIASHISSISSRTGDPAPNMENITSGFLGPLLVLQAGFFLLTRILTIPQSLDSWWTSLNFLGGSPVCLGQNSQSPTSNHSPTSCPPICPGYRWMCLRRFIIFLFILLLCLIFLLVLLDYQGFPGAMLSEVLLVSAPGKVILHGEHAVVHGKVALAVSLNLRTFLRLQPHSNGKVDLSLPNIGIKRAWDVARLQSLDTSFLGSHSVMQPGVQWCDHSSLFLQPPGLKRSSCLSLLRAGTTEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKSSQRSWPPS

SEQ ID NO: 845672 - protein, 128 aa, Homo sapiens
MLSAPGCERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 845673 - protein, 510 aa, Homo sapiens
SHPQAMQWNSTAFHQALQDPRVRGLYFPAGGSSSGTVNPAQNIASHISSISSRTGDPAPNMENITSGFLGPLLVLQAGFFLLTRILTIPQSLDSWWTSLNFLGGSPVCLGQNSQSPTSNHSPTSCPPICPGYRWMCLRRFIIFLFILLLCLIFLLVLLDYQGFPGAMLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 845674 - protein, 73 aa, Homo sapiens
HSKLTGAGGGGCGITLLKPGIPGVGGPGCQPGLLRGVHLENSLERKKRPGNRSQLRCVALGKLVNLWSLLPHW

SEQ ID NO: 845675 - protein, 433 aa, Homo sapiens
PLEARALWVVGVGELLRLRRGGAAAGEAAAAAGFPGAMLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 845676 - protein, 237 aa, Homo sapiens
MATQPVPGMEAQLWPAAEAPCSPNPVSPLVPPFFLRIRVGGFPDCSQSCPSSSILSSVWTCLLFTLQSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 845677 - protein, 202 aa, Homo sapiens
MIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 845678 - protein, 514 aa, Homo sapiens
SHPQAMQWNSTAFHQALQDPRVRGLYFPAGGSSSGTVNPAQNIASHISSISSRTGDPAPNMENITSGFLGPLLVLQAGFFLLTRILTIPQSLDSWWTSLNFLGGSPVCLGQNSQSPTSNHSPTSCPPICPGYRWMCLRRFIIFLFILLLCLIFLLVLLDYARIPRSHVVRSPTGVCSGESHPSWRTCRGTWQGSTGCILELENIPPASTPQQWESGPQLTQHWYQAGLGCGQASVTGHKLSGALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 845679 - protein, 263 aa, Homo sapiens
PLEARALWVVGVGELLRLRRGGAAAGEAAAAAGFPGAMLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKR

SEQ ID NO: 845680 - protein, 31 aa, Homo sapiens
MLLFHQISQYWGIWPSCLNLLPPPSLYGMTL

SEQ ID NO: 845681 - protein, 544 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 845682 - protein, 89 aa, Homo sapiens
SFSLPPPPTTAAATTAAAVISYPLWSSFLPQFLLLLPSPAPPAQQRRAEPSAAALLRSDQEEAGTEVSPKKEQLSPCILWQLVCPALSL

SEQ ID NO: 845683 - protein, 176 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTGIPEQWARLLQTSNITKLEQKKNPQAVLDVLKFYDSKETVNNQKYMSFTSGDKSAHGYIAAHPSVSEKLKTVSHDWCFQRFKRI

SEQ ID NO: 845684 - protein, 544 aa, Homo sapiens; identical to SEQ ID NO: 845681

SEQ ID NO: 845685 - protein, 544 aa, Homo sapiens; identical to SEQ ID NO: 845681

SEQ ID NO: 845686 - protein, 307 aa, Homo sapiens
MVAGKVLMAKQEIVECVASAAMISPGKLPGETHSQRIAEEALGGLDNSKKQKGNAAGNKISQLPSQDRHFSLATFNRRIPTEHSVLESHESEGSFSMNSNDITQQSVDTREKLYECFDCGKAFCQSSKLIRHQRIHTGERPYACKECGKAFSLSSDLVRHQRIHSGEKPYECCECGKAFRGSSELIRHRRIHTGEKPYECGECGKAFSRSSALIQHKKIHTGDKSYECIACGKAFGRSSILIEHQRIHTGEKPYECNECGKSFNQSSALTQHQRIHTGEKPYECSECRKTFRHRSGLMQHQRTHTRV

SEQ ID NO: 845687 - protein, 104 aa, Homo sapiens
LLMLEQFLAILPEELQAWLREHRPENGEEAVTMLEELEKELEEPRQQDTTHGQEMFWQEMTSTGALKSLSLNSPVQPLENQCKTETQESQAFQERGEKPQSMWG

SEQ ID NO: 845688 - protein, 403 aa, Homo sapiens
MLEQFLAILPEELQAWLREHRPENGEEAVTMLEELEKELEEPRQQDTTHGQEMFWQEMTSTGALKSLSLNSPVQPLENQCKTETQESQAFQERDGRMVAGKVLMAKQEIVECVASAAMISPGKLPGETHSQRIAEEALGGLDNSKKQKGNAAGNKISQLPSQDRHFSLATFNRRIPTEHSVLESHESEGSFSMNSNDITQQSVDTREKLYECFDCGKAFCQSSKLIRHQRIHTGERPYACKECGKAFSLSSDLVRHQRIHSGEKPYECCECGKAFRGSSELIRHRRIHTGEKPYECGECGKAFSRSSALIQHKKIHTGDKSYECIACGKAFGRSSILIEHQRIHTGEKPYECNECGKSFNQSSALTQHQRIHTGEKPYECSECRKTFRHRSGLMQHQRTHTRV

SEQ ID NO: 845689 - protein, 123 aa, Homo sapiens
NSEGISQTQISISSLPHLGSLFRLSLPRMSGEATVLAYHAPEEQEGLLVVKVEEENYVLDQDFGLQENPWSQEMFWQEMTSTGALKSLSLNSPVQPLENQCKTETQESQAFQERGEKPQSMWG

SEQ ID NO: 845690 - protein, 424 aa, Homo sapiens
NSEGISQTQISISSLPHLGSLFRLSLPRMSGEATVLAYHAPEEQEGLLVVKVEEENYVLDQDFGLQENPWSQEMFWQEMTSTGALKSLSLNSPVQPLENQCKTETQESQAFQERDGRMVAGKVLMAKQEIVECVASAAMISPGKLPGETHSQRIAEEALGGLDNSKKQKGNAAGNKISQLPSQDRHFSLATFNRRIPTEHSVLESHESEGSFSMNSNDITQQSVDTREKLYECFDCGKAFCQSSKLIRHQRIHTGERPYACKECGKAFSLSSDLVRHQRIHSGEKPYECCECGKAFRGSSELIRHRRIHTGEKPYECGECGKAFSRSSALIQHKKIHTGDKSYECIACGKAFGRSSILIEHQRIHTGEKPYECNECGKSFNQSSALTQHQRIHTGEKPYECSECRKTFRHRSGLMQHQRTHTRV

SEQ ID NO: 845691 - protein, 108 aa, Homo sapiens
FIGIQPHSFIYILSMTVFSIMAEWSRKDSGSVSSKDENIYYFCLYQKRRKERMKERKEGKGREGRKEGRGRKKERKERKKERKKERKKERKKERKKERRKKEREKEKK

SEQ ID NO: 845692 - protein, 668 aa, Homo sapiens
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGKKDLDGLIKVDPETNKNITRGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 845693 - protein, 148 aa, Homo sapiens
MNKSLNRAKSLESLIYMSTRTDKDGKGIQSLGSPIKVNQRTDKNEKGGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKDL

SEQ ID NO: 845694 - protein, 628 aa, Homo sapiens
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEKGSEDLDNATEVNPKGHENTTGGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 845695 - protein, 507 aa, Homo sapiens
MSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEKGSEDLDNATEVNPKGHENTTGGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 845696 - protein, 424 aa, Homo sapiens
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGGQSLDNLIKVTPEVKRSNQGSKDLNNFIKVYPGTEKSTEGGQSLDSLIKVTPERNRTNQGNQDLENLIKVIPSANKSSEQGPDELLVTAPTCQNIIEPNLI

SEQ ID NO: 845697 - protein, 688 aa, Homo sapiens
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNIRSQDLDNIVKVATSLQRSDKGEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGKKDLDGLIKVDPETNKNITRGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 845698 - protein, 605 aa, Homo sapiens
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEKGSEDLDNATEVNPKGHENTTGGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 845699 - protein, 605 aa, Homo sapiens; identical to SEQ ID NO: 845698

SEQ ID NO: 845700 - protein, 263 aa, Homo sapiens
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKG

SEQ ID NO: 845701 - protein, 1937 aa, Homo sapiens
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPERDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLANCFDLTPDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRGLDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 845702 - protein, 113 aa, Homo sapiens
QNPANFCFSRDGVSPCCPGWSQSPDLKRSTHLSLHYEELPAQEEPPEPPLQIGSCSGYMELMVKLKQNEAFPGPKVGPQAPGEGVSTPSQDSSSSARLIIYSPQWGCQVGDLL

SEQ ID NO: 845703 - protein, 1904 aa, Homo sapiens
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPERDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRGDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRLCLCLDVDLLELVIKTWKGSTEGKLSQPLFELRCSNNVVHVHSCADSCALLVNLLQYVMSTGDLHPPPRPPSPTEIAGQKLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 845704 - protein, 1928 aa, Homo sapiens
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPERDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRGDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 845705 - protein, 1550 aa, Homo sapiens
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPERDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRGDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLVL

SEQ ID NO: 845706 - protein, 92 aa, Homo sapiens
KRLEAVHGELVLDMEHGTLFSVSQYCGQPGLGYFCLEAEKATLYHRGVRPGGRSPLGSRVGGGGLSGRMWALGGVGSQLAWQGAHETPPQRP

SEQ ID NO: 845707 - protein, 1928 aa, Homo sapiens; identical to SEQ ID NO: 845704

SEQ ID NO: 845708 - protein, 1960 aa, Homo sapiens
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPERDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRGDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFRYGCWTAGGGPWARLLGARPVSKEPPLPAPLPREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 845709 - protein, 1707 aa, Homo sapiens
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPERDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRGDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHG

SEQ ID NO: 845710 - protein, 76 aa, Homo sapiens
LKPGNDPTLRVIWALKALQFPGFFKKMSNVLPHMSDAHGSPPTRKITIEDHLLEDVVLGAVFFPVADRLDLHRRQY

SEQ ID NO: 845711 - protein, 130 aa, Homo sapiens
VSTLWVILHLCKRGIPLCALINQHLSGLARRFPDVKFIKANSTTRIPNYPDRNLPMVFVYLEGDIKAQLIGPLVFGGMNLTRDELGWKLSESRAVKTDLEENPKKPIEGVLLSSVQSSVPMRRDSDSKGD

SEQ ID NO: 845712 - protein, 97 aa, Homo sapiens [sequence omitted]

SEQ ID NO: 845713 - protein, 13 aa, Homo sapiens
MLSRNDEAASAQQ

SEQ ID NO: 845714 - protein, 13 aa, Homo sapiens
MLSRNDEAASAQQ

SEQ ID NO: 845715 - protein, 87 aa, Homo sapiens
RERGREVRKAGGGSRTHREGSDGIASHQHLLSWSQAQGSSEQELHYASLQRLPVPSSEGPDLRGRDKRGTKEDPRADYACIAENKPT

SEQ ID NO: 845716 - protein, 110 aa, Homo sapiens
MYLRGPGAGRAPASGSGPSVRLPVLAASKSTFCPGPRPRAPQSRNSTMHLCRGCQCPAVRDLTSGAETREAPRRIQELTMPALLRTNPPEHPRHLPQPRRVDRVPLWSSQ

SEQ ID NO: 845717 - protein, 103 aa, Homo sapiens
MYLRGPGAGRAPASGSGPSVRLPVLAASKRPRAPQSRNSTMHLCRGCQCPAVRDLTSGAETREAPRRIQELTMPALLRTNPPEHPRHLPQPRRVDRVPLWSSQ

SEQ ID NO: 845718 - protein, 43 aa, Homo sapiens
MLSRNDVKRLERSWHLSVLVPGPGLLRAGTPLCISAEAASAQQ

SEQ ID NO: 845719 - protein, 103 aa, Homo sapiens; identical to SEQ ID NO: 845717

SEQ ID NO: 845720 - protein, 53 aa, Homo sapiens
MTQGSSEQELHYASLQRLPVPSSEGPDLRGRDKRGTKEDPRADYACIAENKPT

SEQ ID NO: 845721 - protein, 35 aa, Homo sapiens
MLSRNDAPSVLVPGPGLLRAGTPLCISAEAASAQQ

SEQ ID NO: 845722 - protein, 13 aa, Homo sapiens
MLSRNDEAASAQQ

SEQ ID NO: 845723 - protein, 35 aa, Homo sapiens; identical to SEQ ID NO: 845721

SEQ ID NO: 845724 - protein, 35 aa, Homo sapiens; identical to SEQ ID NO: 845721

SEQ ID NO: 845725 - protein, 187 aa, Homo sapiens
MGLYPLPLLNSTLDDGKATLTPSNTPLGRNLSTHQTYPVVADPHSPFAIKQETPEVSSSSSTPSSLSSSAFLDLQQVGSGVPPFNAFPHAASVYGQFTGQALLSGREMVGPTLPGYPPHIPTSGQGSYASSAIAGMVAGKERAGRKGSTAKRKYWSKVGHKEQEAYCALFIDFPKGIEGWTKEGISL

SEQ ID NO: 845726 - protein, 454 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVAAPPFWICSKSAPGSRPSMPFPMLPPCTGSSRARPSSQGERWWGPRCPDTHPTSPPADRAAMPPLPSQAWWQEVNTLAMPMATPPTPPTARPGASPTPAC

SEQ ID NO: 845727 - protein, 506 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVADPHSPFAIKQETPEVSSSSSTPSSLSSSAFLDLQQVGSGVPPFNAFPHAASVYGQFTGQALLSGREMVGPTLPGYPPHIPTSGQGSYASSAIAGMVAGSEYSGNAYGHTPYSSYSEAWRFPNSSLLSSPYYYSSTSRPSAPPTTATAFDHL

SEQ ID NO: 845728 - protein, 343 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQEVNTLAMPMATPPTPPTARPGASPTPAC

SEQ ID NO: 845729 - protein, 506 aa, Homo sapiens; identical to SEQ ID NO: 845727

SEQ ID NO: 845730 - protein, 499 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVADPHSPFAIKQETPEVSSSSSTPSSLSSSAFLDLQQVGSGVPPFNAFPHAASVYGQFTGQALLSGREMVGPTLPGYPPHIPTSGQGSYASSAIAGMVAGKERAGRKGSTAKRKYWSKEVNTLAMPMATPPTPPTARPGASPTPAC

SEQ ID NO: 845731 - protein, 506 aa, Homo sapiens; identical to SEQ ID NO: 845727

SEQ ID NO: 845732 - protein, 506 aa, Homo sapiens; identical to SEQ ID NO: 845727

SEQ ID NO: 845733 - protein, 186 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINR

SEQ ID NO: 845734 - protein, 123 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHPGLIISIIPLLFFIQINNNLFSCSQLAQ

SEQ ID NO: 845735 - protein, 506 aa, Homo sapiens; identical to SEQ ID NO: 845727

SEQ ID NO: 845736 - protein, 203 aa, Homo sapiens
MDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVAAPPFWICSKSAPGSRPSMPFPMLPPCTGSSRARPSSQVRQGGPGAMQ

SEQ ID NO: 845737 - protein, 377 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGERWWGPRCPDTHPTSPPADRAAMPPLPSQAWWQEVNTLAMPMATPPTPPTARPGASPTPAC

SEQ ID NO: 845738 - protein, 443 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVAGREMVGPTLPGYPPHIPTSGQGSYASSAIAGMVAGSEYSGNAYGHTPYSSYSEAWRFPNSSLLSSPYYYSSTSRPSAPPTTATAFDHL

SEQ ID NO: 845739 - protein, 197 aa, Homo sapiens [sequence omitted]

SEQ ID NO: 845740 - protein, 197 aa, Homo sapiens [sequence omitted]

SEQ ID NO: 845741 - protein, 362 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQVRSWALGGEQGGQGPEKVYSPNEPVLHQSSWKLHQWAQGTCLMQLQA

SEQ ID NO: 845742 - protein, 501 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVADPHSPFAIKQETPEVSSSSSTPSSLSSSAFLDLQQVGSGVPPFNAFPHAASVYGQFTGQALLSGREMVGPTLPGYPPHIPTSGQGSYASSAIAGMVAGKERAGRKGSTAKRKYWSKVGHKEQEAYCALFIDFPKGIEGWTKEGISL

SEQ ID NO: 845743 - protein, 120 aa, Homo sapiens
GNKLQKEERHRAQGTLRRADPSSEGLQPAGQGSGRRGPDLREEAPSPRRAASDSPAMPHNSIRSGHGGLNQLGGAFVNGRPLPEVVRQRIVDLAHQGVRPCDISRQLRVSHGCVSKILGR

SEQ ID NO: 845744 - protein, 540 aa, Homo sapiens
MNGEAICSALPTIPYHKLADLRYLSRGASGTVSSARHADWRVQVAVKHLHIHTPLLDSERKDVLREAEILHKARFSYILPILGICNEPEFLGIVTEYMPNGSLNELLHRKTEYPDVAWPLRFRILHEIALGVNYLHNMTPPLLHHDLKTQNILLDNEFHVKIADFGLSKWRMMSLSQSRSSKSAPEGGTIIYMPPENYEPGQKSRASIKHDIYSYAVITWEVLSRKQPFEDVTNPLQIMYSVSQGHRPVINEESLPYDIPHRARMISLIESGWAQNPDERPSFLKCLIELEPVLRTFEEITFLEAVIQLKKTKLQSVSSAIHLCDKKKMELSLNIPVNHGPQEESCGSSQLHENSGSPETSRSLPAPQDNDFLSRKAQDCYFMKLHHCPGNHSWDSTISGSQRAAFCDHKTTPCSSAIINPLSTAGNSERLQPGIAQQWIQSKREDIVNQMTEACLNQSLDALLSRDLIMKEDYELVSTKPTRTSKVRQLLDTTDIQGEEFAKVIVQKLKDNKQMGLQPYPEILVVSRSPSLNLLQNKSM

SEQ ID NO: 845745 - protein, 540 aa, Homo sapiens; identical to SEQ ID NO: 845744

SEQ ID NO: 845746 - protein, 403 aa, Homo sapiens
MTPPLLHHDLKTQNILLDNEFHVKIADFGLSKWRMMSLSQSRSSKSAPEGGTIIYMPPENYEPGQKSRASIKHDIYSYAVITWEVLSRKQPFEDVTNPLQIMYSVSQGHRPVINEESLPYDIPHRARMISLIESGWAQNPDERPSFLKCLIELEPVLRTFEEITFLEAVIQLKKTKLQSVSSAIHLCDKKKMELSLNIPVNHGPQEESCGSSQLHENSGSPETSRSLPAPQDNDFLSRKAQDCYFMKLHHCPGNHSWDSTISGSQRAAFCDHKTTPCSSAIINPLSTAGNSERLQPGIAQQWIQSKREDIVNQMTEACLNQSLDALLSRDLIMKEDYELVSTKPTRTSKVRQLLDTTDIQGEEFAKVIVQKLKDNKQMGLQPYPEILVVSRSPSLNLLQNKSM

SEQ ID NO: 845747 - protein, 403 aa, Homo sapiens; identical to SEQ ID NO: 845746

SEQ ID NO: 845748 - protein, 443 aa, Homo sapiens
MPNGSLNELLHRKTEYPDVAWPLRFRILHEIALGVNYLHNMTPPLLHHDLKTQNILLDNEFHVKIADFGLSKWRMMSLSQSRSSKSAPEGGTIIYMPPENYEPGQKSRASIKHDIYSYAVITWEVLSRKQPFEDVTNPLQIMYSVSQGHRPVINEESLPYDIPHRARMISLIESGWAQNPDERPSFLKCLIELEPVLRTFEEITFLEAVIQLKKTKLQSVSSAIHLCDKKKMELSLNIPVNHGPQEESCGSSQLHENSGSPETSRSLPAPQDNDFLSRKAQDCYFMKLHHCPGNHSWDSTISGSQRAAFCDHKTTPCSSAIINPLSTAGNSERLQPGIAQQWIQSKREDIVNQMTEACLNQSLDALLSRDLIMKEDYELVSTKPTRTSKVRQLLDTTDIQGEEFAKVIVQKLKDNKQMGLQPYPEILVVSRSPSLNLLQNKSM

SEQ ID NO: 845749 - protein, 293 aa, Homo sapiens
MIPLLLRACGRQPQEPSLLRCSQGGPTHCLHSEAVAIGPRGCSGSLRWLQESDAAPLPLSCHLAAHRGEDAPAVSPHGIPEGRVRAVRREGSEGPAREPGSIWGTDARVRGSSPNPSMGTGWEQAQRKPHWRQQPRADCKTLVPTAWRAPPRHKLHWFSMLRKKQHGCKDCKQCPFMISQLSRAEVAVGSVGALSGVSQTDVRPWWAALSPGGSGEASASRTIQAVDKSTPHGCRTEVPKSLSLVLWSLHLQTSNGALSKLWSNIHHIKFTILTIVKCMVCGIKYIHIVVQPS

SEQ ID NO: 845750 - protein, 320 aa, Homo sapiens
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREDCLQGIRSFLRTHQQVASSLTSIGLALTVSALLFSSFLWFAIRCGCSLDRKGKYTLTPRACGRQPQEPSLLRCSQGGPTHCLHSEAVAIGPRGCSGSLRWLQESDAAPLPLSCHLAAHRALQGRSRGGLSGCPERGLSD

SEQ ID NO: 845751 - protein, 212 aa, Homo sapiens
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREVRGGPGCWPGKTLGGWTPWGPTPRPRAILPP

SEQ ID NO: 845752 - protein, 290 aa, Homo sapiens
MVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREDCLQGIRSFLRTHQQVASSLTSIGLALTVSALLFSSFLWFAIRCGCSLDRKGKYTLTPRACGRQPQEPSLLRCSQGGPTHCLHSEAVAIGPRGCSGSLRWLQESDAAPLPLSCHLAAHRALQGRSRGGLSGCPERGLSD

SEQ ID NO: 845753 - protein, 124 aa, Homo sapiens
MVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKVSVLWEEVSFQPSGEHRG

SEQ ID NO: 845754 - protein, 339 aa, Homo sapiens
MLPGEGRPHPGAVGQPRVSPSQVSALLFSSFLWFAIRCGCSLDRKGKYTLTPRACGRQPQEPSLLRCSQGGPTHCLHSEAVAIGPRGCSGSLRWLQESDAAPLPLSCHLAAHRGEDAPAVSPHGIPEGRVRAVRREGSEGPAREPGSIWGTDARVRGSSPNPSMGTGWEQAQRKPHWRQQPRADCKTLVPTAWRAPPRHKLHWFSMLRKKQHGCKDCKQCPFMISQLSRAEVAVGSVGALSGVSQTDVRPWWAALSPGGSGEASASRTIQAVDKSTPHGCRTEVPKSLSLVLWSLHLQTSNGALSKLWSNIHHIKFTILTIVKCMVCGIKYIHIVVQPS

SEQ ID NO: 845755 - protein, 124 aa, Homo sapiens; identical to SEQ ID NO: 845753

SEQ ID NO: 845756 - protein, 210 aa, Homo sapiens
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREVLCPALGWMLGTQSEFEVARPRGANVWPN

SEQ ID NO: 845757 - protein, 154 aa, Homo sapiens
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKVSVLWEEVSFQPSGEHRG

SEQ ID NO: 845758 - protein, 126 aa, Homo sapiens
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQHPSFRPGC

SEQ ID NO: 845759 - protein, 223 aa, Homo sapiens
MVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREDCLQGIRSFLRTHQQVASSLTSIGLALTVSALLFSSFLWFAIRCGCSLDRKGKYTLTPRSPGQKSRWAQWVP

SEQ ID NO: 845760 - protein, 481 aa, Homo sapiens
LPRNVPHPPPCCPGIGLGGRCSSMAPQRPLVQAGRAAQGGYHACCPLTGLPSGHPELPEDTPAGRLQPDQHRPGPHGTLSPPSLPLPTSCPSACPAPDSDGRVTRDRISGLEPHWLPTSGSCSGVTGPASYSWAAPLHCRVLMLPGEGRPHPGAVGQPRVSPSQVSALLFSSFLWFAIRCGCSLDRKGKYTLTPRACGRQPQEPSLLRCSQGGPTHCLHSEAVAIGPRGCSGSLRWLQESDAAPLPLSCHLAAHRGEDAPAVSPHGIPEGRVRAVRREGSEGPAREPGSIWGTDARVRGSSPNPSMGTGWEQAQRKPHWRQQPRADCKTLVPTAWRAPPRHKLHWFSMLRKKQHGCKDCKQCPFMISQLSRAEVAVGSVGALSGVSQTDVRPWWAALSPGGSGEASASRTIQAVDKSTPHGCRTEVPKSLSLVLWSLHLQTSNGALSKLWSNIHHIKFTILTIVKCMVCGIKYIHIVVQPS

SEQ ID NO: 845761 - protein, 790 aa, Homo sapiens
MEKMSRVTTALGGSVLTGRTMHCHLDAPANAISVCRDAAQVVVAGRSIFKIYAIEEEQFVEKLNLRVGRKPSLNLSCADVVWHQMDENLLATAATNGVVVTWNLGRPSRNKQDQLFTEHKRTVNKVCFHPTEAHVLLSGSQDGFMKCFDLRRKDSVSTFSGQSESVRDVQFSIRDYFTFASTFENGNVQLWDIRRPDRCERMFTAHNGPVFCCDWHPEDRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQEHWYTSYIDLLQRFRLWNVSNEVVKLSTSRAVSCLNQASTTLHVNCSHCKRPMSSRGWVCDRCHRCASMCAVCHHVVKGLFVWCQGCSHGGHLQHIMKWLEGSSHCPAGCGHLCEYS

SEQ ID NO: 845762 - protein, 816 aa, Homo sapiens
MEKMSRVTTALGGSVLTGRTMHCHLDAPANAISVCRDAAQVVVAGRSIFKIYAIEEEQFVEKLNLRVGRKPSLNLSCADVVWHQMDENLLATAATNGVVVTWNLGRPSRNKQDQLFTEHKRTVNKVCFHPTEAHVLLSGSQDGFMKCFDLRRKDSVSTFSGQSESVRDVQFSIRDYFTFASTFENGNVQLWDIRRPDRCERMFTAHNGPVFCCDWHPEDRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNRYDAGGSSPQGLGLLEPTHPWALPAPSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQEHWYTSYIDLLQRFRLWNVSNEVVKLSTSRAVSCLNQASTTLHVNCSHCKRPMSSRGWVCDRCHRCASMCAVCHHVVKGLFVWCQGCSHGGHLQHIMKWLEGSSHCPAGCGHLCEYS

SEQ ID NO: 845763 - protein, 845 aa, Homo sapiens
MEKMSRVTTALGGSVLTGRTMHCHLDAPANAISVCRDAAQVVVAGRSIFKIYAIEEEQFVEKLNLRVGRKPSLNLSCADVVWHQMDENLLATAATNGVVVTWNLGRPSRNKQDQLFTEHKRTVNKVCFHPTEAHVLLSGSQDGFMKCFDLRRKDSVSTFSGQSESVRDVQFSIRDYFTFASTFENGNVQLWDIRRPDRCERMFTAHNGPVFCCDWHPEDRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQVCGGGASPLQRRPWHPDPDCRALPPPGALVHFLHRPAAALPPLERVQRGGQAEHQPRRQLPQPGLHHPARQLQPLQAAHEQPGLGLRQVPPLRQHVCRLPPRSQGSLRVVPGLQPRRPPAAHHEVAGRQLPLSRRLRPPLRVLLTGHLLGLPGRPRAEPRLVLCPRRAEAGT

SEQ ID NO: 845764 - protein, 846 aa, Homo sapiens
MEKMSRVTTALGGSVLTGRTMHCHLDAPANAISVCRDAAQVVVAGRSIFKIYAIEEEQFVEKLNLRVGRKPSLNLSCADVVWHQMDENLLATAATNGVVVTWNLGRPSRNKQDQLFTEHKRTVNKVCFHPTEAHVLLSGSQDGFMKCFDLRRKDSVSTFSGQSESVRDVQFSIRDYFTFASTFENGNVQLWDIRRPDRCERMFTAHNGPVFCCDWHPEDRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQVCGGGASPLQRRPWHPDPDCRALPPPGALVHFLHRPAAALPPLERVQRGGQAEHQPRRQLPQPGLHHPARQLQPLQAAHEQPGLGLRQVGQWGREVGQGPAGSAAAPAEAPSLPPAPRCHRCASMCAVCHHVVKGLFVWCQGCSHGGHLQHIMKWLEGSSHCPAGCGHLCEYS

SEQ ID NO: 845765 - protein, 448 aa, Homo sapiens [sequence omitted]

SEQ ID NO: 845766 - protein, 778 aa, Homo sapiens
MEKMSRVTTALGGSVLTGRTMHCHLDAPANAISVCRDAAQVVVAGRSIFKIYAIEEEQFVEKLNLRVGRKPSLNLSCADVVWHQMDENLLATAATNGVVVTWNLGRPSRNKQDQLFTEHKRTVNKVCFHPTEAHVLLSGSQDGFMKCFDLRRKDSVSTFSGQSESVRDVQFSIRDYFTFASTFENGNVQLWDIRRPDRCERMFTAHNGPVFCCDWHPEDRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQEHWYTSYIDLLQRFRLWNVSNEVVKLSTSRAVSCLNQASTTLHVNCSHCKRPMSSRGWVCDRWGSGVGRWGRGLQAAQQPPLRHPPSRPPPGATAAPACVPSATT

SEQ ID NO: 845767 - protein, 725 aa, Homo sapiens
MEKMSRVTTALGGSVLTGRTMHCHLDAPANAISVCRDAAQVVVAGRSIFKIYAIEEEQFVEKLNLRVGRKPSLNLSCADVVWHQMDENLLATAATNGVVVTWNLGRPSRNKQDQLFTEHKRTVNKVCFHPTEAHVLLSGSQDGFMKCFDLRRKDSVSTFSGQSESVRDVQFSIRDYFTFASTFENGNVQLWDIRRPDRCERMFTAHNGPVFCCDWHPEDRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQEHWYTSYIDLLQRFRLWNVSNEVVKLSTSRAVSCLNQASTTLHVNCSHCSTS

SEQ ID NO: 845768 - protein, 579 aa, Homo sapiens
GLGGPSSHRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQEHWYTSYIDLLQRFRLWNVSNEVVKLSTSRAVSCLNQASTTLHVNCSHCKRPMSSRGWVCDRCHRCASMCAVCHHVVKGLFVWCQGCSHGGHLQHIMKWLEGSSHCPAGCGHLCEYS

SEQ ID NO: 845769 - protein, 103 aa, Homo sapiens
FFFFFRWSLTLSHPGWSAVAHDLGLLQPPPPGFKQFSYLSLPSSWYYRYEEAEVRKKLEEKDRQEEAQRLQQKRQEQITMVECHQLRQEPALFTSFVFTASGI

SEQ ID NO: 845770 - protein, 1089 aa, Homo sapiens
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKPTCYPKAEISRLSASQIRNLNPVFGGSGPALTGLRNLGNTCYMNSILQCLCNAPHLADYFNRNCYQDDINRSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 845771 - protein, 1089 aa, Homo sapiens; identical to SEQ ID NO: 845770

SEQ ID NO: 845772 - protein, 899 aa, Homo sapiens
MMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKPTCYPKAEISRLSASQIRNLNPVFGGSGPALTGLRNLGNTCYMNSILQCLCNAPHLADYFNRNCYQDDINRSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 845773 - protein, 1034 aa, Homo sapiens
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKPTCYPKAEISRLSASQIRNLNPVFGGSGPALTGLRNLGNTCYMNSILQCLCNAPHLADYFNRNCYQDDINRSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSVSISLN

SEQ ID NO: 845774 - protein, 718 aa, Homo sapiens
MGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKPTCYPKAEISRLSASQIRNLNPVFGGSGPALTGLRNLGNTCYMNSILQCLCNAPHLADYFNRNCYQDDINRSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 845775 - protein, 1046 aa, Homo sapiens
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKPTCYPKAEISRLSASQIRNLNPVFGGSGPALTGLRNLGNTCYMNSILQCLCNAPHLADYFNRNCYQDDINRSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHQNGSMGERNVKLSIHI

SEQ ID NO: 845776 - protein, 1118 aa, Homo sapiens
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKPFKIKGQPESGILRTGTFREDTDDTERNKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKPTCYPKAEISRLSASQIRNLNPVFGGSGPALTGLRNLGNTCYMNSILQCLCNAPHLADYFNRNCYQDDINRSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 845777 - protein, 765 aa, Homo sapiens
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKPFKIKGQPESGILRTGTFREDTDDTERNKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKFGTSILFLEVLDQLLLDFVT

SEQ ID NO: 845778 - protein, 1047 aa, Homo sapiens
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKPFKIKGQPESGILRTGTFREDTDDTERNKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 845779 - protein, 1089 aa, Homo sapiens; identical to SEQ ID NO: 845770

SEQ ID NO: 845780 - protein, 230 aa, Homo sapiens
DYRPSPSPLHDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 845781 - protein, 183 aa, Homo sapiens
MVFRECRLTVHLSSRVSNTDPRYVKLYAPGDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 845782 - protein, 189 aa, Homo sapiens
PGDSRGSGLHLVAQGCSRSRPAHREPSSGQGSPRQPRAQPISAPDCTRAMVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQVWGDIGRGVRDICVLIVLDMYLISYEILNSYPLYCILCK

SEQ ID NO: 845783 - protein, 323 aa, Homo sapiens
PGDSRGSGLHLVAQGCSRSRPAHREPSSGQGSPRQPRAQPISAPDCTRAMVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 845784 - protein, 339 aa, Homo sapiens
ALVGCPPQTGRTGYIRENAPCTTHATPTTQGCSRSRPAHREPSSGQGSPRQPRAQPISAPDCTRAMVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 845785 - protein, 339 aa, Homo sapiens; identical to SEQ ID NO: 845784

SEQ ID NO: 845786 - protein, 389 aa, Homo sapiens
QLPTTGFDSERTPRGVSIFPIYFQPLVPLEIKAKAPRKVTYSWKFTSWSLFRSKSSISLAISASCSFEPMVSSFWISSFSSFLLRVCLSPSLPEYLWKMATRRPMNPGGMPWLSSAECRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 845787 - protein, 197 aa, Homo sapiens
SRISSYRIRYVAKKKLEAQSCDDSFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 845788 - protein, 305 aa, Homo sapiens
ALVGCPPQTGRTGYIRENAPCTTHATPTTQGCSRSRPAHREPSSGQGSPRQPRAQPISAPDCTRAMVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 845789 - protein, 305 aa, Homo sapiens; identical to SEQ ID NO: 845788

SEQ ID NO: 845790 - protein, 301 aa, Homo sapiens
ALVGCPPQTGRTGYIRENAPCTTHATPTTQGCSRSRPAHREPSSGQGSPRQPRAQPISAPDCTRAMVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 845791 - protein, 179 aa, Homo sapiens
ALVGCPPQTGRTGYIRENAPCTTHATPTTQGCSRSRPAHREPSSGQGSPRQPRAQPISAPDCTRAMVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFLLHLLNLMSETW

SEQ ID NO: 845792 - protein, 339 aa, Homo sapiens; identical to SEQ ID NO: 845784

SEQ ID NO: 845793 - protein, 339 aa, Homo sapiens; identical to SEQ ID NO: 845784

SEQ ID NO: 845794 - protein, 339 aa, Homo sapiens; identical to SEQ ID NO: 845784

SEQ ID NO: 845795 - protein, 169 aa, Homo sapiens
ALVGCPPQTGRTGYIRENAPCTTHATPTTQGCSRSRPAHREPSSGQGSPRQPRAQPISAPDCTRAMVGRRALIVLAHSERTSFNYAMKEAAAAALKKKGWEVVESDLYAMNFNPIISRKDITGKLKDPANFQYPAESVLAYKEGHLSPDIVAELPPAVVWSPCHSERLV

SEQ ID NO: 845796 - protein, 301 aa, Homo sapiens; identical to SEQ ID NO: 845790

SEQ ID NO: 845797 - protein, 323 aa, Homo sapiens
ALVGCPPQTGRTGYIRENAPCTTHATPTTQGCSRSRPAHREPSSGQGSPRQPRAQPISAPDCTRAMVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSLALLPKLECSGSIWAHYNLRLLDSSDSPVSASQLARITSTHHHAQLIFLFLVETGFCHVGQVGLKLLTSGDPLAWPPKVLGLQV

SEQ ID NO: 845798 - protein, 280 aa, Homo sapiens
ALVGCPPQTGRTGYIRENAPCTTHATPTTQGCSRSRPAHREPSSGQGSPRQPRAQPISAPDCTRAMVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVPLELGRPLEL

SEQ ID NO: 845799 - protein, 147 aa, Homo sapiens
PAAREADAGELLEPRRRRLHWAENVPLHSSLGVTERDSVPKRNNQPINHCPSLPVFEPLCQRRKPCISCAFPGLTLSSPRPRSALQVLHKACEVARRHNYFPGGVALIWATYYESCISSEQSCINEWNAMQDLESTRPDSPALFVDK

SEQ ID NO: 845800 - protein, 255 aa, Homo sapiens
TSVAPSHRAAAMALVTLQRSPTPSAASSSASNSELEAGSEEDRKLNLSLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDK

SEQ ID NO: 845801 - protein, 286 aa, Homo sapiens
TSVAPSHRAAAMALVTLQRSPTPSAASSSASNSELEAGSEEDRKLNLSLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKE

SEQ ID NO: 845802 - protein, 118 aa, Homo sapiens
MSSLPHRSKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDK

SEQ ID NO: 845803 - protein, 43 aa, Homo sapiens
MPILGWVRWVTPVIPALWEAEAGGSQGQEIETILANMVKPCLY

SEQ ID NO: 845804 - protein, 480 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 845805 - protein, 885 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCPENSNICEVCNKWGRLFCCDTCPRSFHEHCHIPSVEANKNPWSCIFCRIKTIQERCPESQSGHQESEVLMRQMLPEEQLKCEFLLLKVYCDSKSCFFASEPYYNREGSQGPQKPMWLNKVKTSLNEQMYTRVEGFVQDMRLIFHNHKEFYREDKFTRLGIQVQDIFEKNFRNIFAIQETSKNIIMFI

SEQ ID NO: 845806 - protein, 480 aa, Homo sapiens; identical to SEQ ID NO: 845804

SEQ ID NO: 845807 - protein, 452 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 845808 - protein, 493 aa, Homo sapiens
RSEQLLSQQPRVEDGGGGGTLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 845809 - protein, 859 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCEEHKKKNPDASVKFSEFLKKCSETWKTIFAKEKGKFEDMAKADKAHYEREMKTYIPPKGEKKKKFKDPNAPKRPPLAFFLFCSEYRPKIKGEHPGLSIDDVVKKLAGMWNNTAAADKQFYEKKAAKLKEKYKKDIAAYRAKGKPNSAKKRVVKAEKSKKKKEEEEDEEDEQEEENEEDDDK

SEQ ID NO: 845810 - protein, 217 aa, Homo sapiens [sequence omitted]

SEQ ID NO: 845811 - protein, 415 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPGKNIRVATRDCRISRVQIQSSVFLINFILSGLLMP

SEQ ID NO: 845812 - protein, 332 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIGKADWESL

SEQ ID NO: 845813 - protein, 285 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTGKTDWVGMNGEEPRGPGWWQRKSLMHNTRRHLFNKQGKIT

SEQ ID NO: 845814 - protein, 113 aa, Homo sapiens
RGRHGRGVKKKIREPRYSQEEMGRETHQDKERYKETPSLETEAEAGEMAEQRGKMRSKMRVKEKNRMRVGVRTVSVDGHNCLLCVNFISFWLRTWNKLQVACIQGTPQGLELT

SEQ ID NO: 845815 - protein, 879 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCEEHKKKNPDASVKFSEFLKKCSETWKTIFAKEKGKFEDMAKADKAHYEREMKTYIPPKGEKKKKFKDPNAPKRPPLAFFLFCSEYRPKIKGEHPGLSIDDVVKKLAGMWNNTAAADKQFYEKKAAKLKEKYKKDIAAYRAKGKPNSAKKRVVKAEKSKKKKEEEEDEEDEQEEENEEDDDK

SEQ ID NO: 845816 - protein, 688 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKVMIK

SEQ ID NO: 845817 - protein, 455 aa, Homo sapiens
MAGGGGDLSTRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 845818 - protein, 203 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGLFLFTTL

SEQ ID NO: 845819 - protein, 831 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCEEHKKKNPDASVKFSEFLKKCSETWKTIFAKEKGKFEDMAKADKAHYEREMKTYIPPKGEKKKKFKDPNAPKRPPLAFFLFCSEYRPKIKGEHPGLSIDDVVKKLAGMWNNTAAADKQFYEKKAAKLKEKYKKDIAAYRAKGKPNSAKKRVVKAEKSKKKKEEEEDEEDEQEEENEEDDDK

SEQ ID NO: 845820 - protein, 462 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRLKKKKEEETMSSPA

SEQ ID NO: 845821 - protein, 278 aa, Homo sapiens
MPDQALQQMLDRSCWVCFATDEDDRTAEWVRPCRCRGSTKWVHQACLQRWVDEKQRGNSTARVACPQCNAEYLIVFPKLGPVVYVLDLADRLISKACPFAAAGIMVGSIYWTAVTYGAVTVMQVVGHKEGLDVMERADPLFLLIGLPTIPVMLILGKMIRWEDYVLRLWRKYSNKLQILNSIFPGIGCPVPRIPAEANPLADHVSATRILCGALVFPTIATIVGKLMFSSVNSNLQRTILGGIAFVAIKGAFKVYFKQQQYLRQAHRKILNYPEQEEA

SEQ ID NO: 845822 - protein, 278 aa, Homo sapiens; identical to SEQ ID NO: 845821

SEQ ID NO: 845823 - protein, 235 aa, Homo sapiens
MPDQALQQMLDRSCWVCFATDEDDRTAEWVRPCRCRGSTKWVHQACLQRWVDEKQRGNSTARVACPQCNAEYLIVFPKLGPVVYVLDLADRLISKACPFAAAGIMVGSIYWTAVTYGAVTVMQVVGHKEGLDVMERADPLFLLIGLPTIPVMLILGKMIRWEDYVLRLWRKYSNKLQILNSIFPGIGCPVPRIPAEANPLADHVSATRILCGALVFPTIATIVGWNCVCCHKRSI

SEQ ID NO: 845824 - protein, 397 aa, Homo sapiens
MDRNLGPTDGNPGRDRRLPASGSSSSLSAASAGLPQALHRRRQASGAAPGSWVTGSRLPPDCGLLRRLSVLLSLGLALSGSTGEGRVRRLRGRCRTKPYSRCWTGTGSCGGDREPPTLALALPAPALEALGSCWVCFATDEDDRTAEWVRPCRCRGSTKWVHQACLQRWVDEKQRGNSTARVACPQCNAEYLIVFPKLGPVVYVLDLADRLISKACPFAAAGIMVGSIYWTAVTYGAVTVMQVVGHKEGLDVMERADPLFLLIGLPTIPVMLILGKMIRWEDYVLRLWRKYSNKLQILNSIFPGIGCPVPRIPAEANPLADHVSATRILCGALVFPTIATIVGKLMFSSVNSNLQRTILGGIAFVAIKGAFKVYFKQQQYLRQAHRKILNYPEQEEA

SEQ ID NO: 845825 - protein, 122 aa, Homo sapiens [sequence omitted]

SEQ ID NO: 845826 - protein, 115 aa, Homo sapiens
VPRERASTALFLKSHMSLGCLPWFSLSKLACAYLLYFVQSVSSGGGKTWEEWGLNPSWQNTVEASKVFCSSLILMNLLCCFDSIINALVETCDKLLLLYFLRNIIKHLGQGKSSR

SEQ ID NO: 845827 - protein, 244 aa, Homo sapiens [sequence omitted]

SEQ ID NO: 845828 - protein, 252 aa, Homo sapiens
CRLYPGLWDIVDPRRSHPEGKSGGKNKQAGRADLVATDSGAAHPAASWKAARKTFFPPGGRKREGAGQTAAGAEALVRAGCAASSGDGPKTTSPRLLWAALRRNPGAHGGGDSYLTKVAPPPAATRRPRSMDRNLGPTDGNPGRDRRLPASGSSSSLSAASAGLPQALHRRRQASGAAPGSWVTGSRLPPDCGLLRRLSVLLSLGLALSGSTGEGRVRRLRGRCRTKPYSRCWTEVAGFVLLLMKMIEQLNG

SEQ ID NO: 845829 - protein, 278 aa, Homo sapiens; identical to SEQ ID NO: 845821

SEQ ID NO: 845830 - protein, 278 aa, Homo sapiens; identical to SEQ ID NO: 845821

SEQ ID NO: 845831 - protein, 204 aa, Homo sapiens
MHKQRGPVVYVLDLADRLISKACPFAAAGIMVGSIYWTAVTYGAVTVMQVVGHKEGLDVMERADPLFLLIGLPTIPVMLILGKMIRWEDYVLRLWRKYSNKLQILNSIFPGIGCPVPRIPAEANPLADHVSATRILCGALVFPTIATIVGKLMFSSVNSNLQRTILGGIAFVAIKGAFKVYFKQQQYLRQAHRKILNYPEQEEA

SEQ ID NO: 845832 - protein, 485 aa, Homo sapiens
SGVCAGLGGACAGPVGSRREPVPRPEPRESSEDSAEAAVSPWASPAAAMGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRPKVKLRRWKGEGRHFTKRILFY

SEQ ID NO: 845833 - protein, 524 aa, Homo sapiens
SGVCAGLGGACAGPVGSRREPVPRPEPRESSEDSAEAAVSPWASPAAAMGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 845834 - protein, 532 aa, Homo sapiens
SGVCAGLGGACAGPVGSRREPVPRPEPRESSEDSAEAAVSPWASPAAAMGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQVSITFFTKGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 845835 - protein, 234 aa, Homo sapiens
MNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 845836 - protein, 524 aa, Homo sapiens; identical to SEQ ID NO: 845833

SEQ ID NO: 845837 - protein, 207 aa, Homo sapiens
SGVCAGLGGACAGPVGSRREPVPRPEPRESSEDSAEAAVSPWASPAAAMGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQDQHSP

SEQ ID NO: 845838 - protein, 510 aa, Homo sapiens
SIYRYTWNTVVLSSVPSDPDADRRARSPWGSQQQHGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 845839 - protein, 75 aa, Homo sapiens
EYTSAEYTSAEYTSAEYSAEYTSPGPATGCLRVLGTYCLHCCHFSLGLITVVWVMPFLPPGLPASVSPLLLVLSP

SEQ ID NO: 845840 - protein, 234 aa, Homo sapiens
MAVMDLSSPWALTKQDSACFHLRNAEEERMIAVFLTTWLQEPMTFKDVAVEFTQEEWMMLDSAQRSLYRDVMLENYRNLTSVEYQLYRLTVISPLDQEEIRNMKKRIPQAICPDQKIQPKTKESTVQKILWEEPSNAVKMIKLTMHNWSSTLREDWECHKIRKQHKIPGGHWRQMIYAPKKTVPQELFRDYHELEENSKLGSKLIFSQSIFTSKHCQKCYSEIGCLKHNSIINN

SEQ ID NO: 845841 - protein, 133 aa, Homo sapiens
MAAVILESIFLKRSQQKKKTSPLNFKKRLFLLTVHKLSYYEYDFERGRRGSKKGSIDVEKITCVETVVPEKNPPPERQIPVRRDQCLRWGTADLKKFATFKFSVNRLVMLCNVEHGQVSFKNSSLYHIGYKES

SEQ ID NO: 845842 - protein, 541 aa, Homo sapiens
MSDVISLFFPATVIRYNSDLVQKYHPCFWIDGQYLCCSQTAKNAMGCQILENRNGSLKPGSSHRKTKKPLPPTPEEDQILKKPLPPEPAAAPVSTSELKKVVALYDYMPMNANDLQLRKGDEYFILEESNLPWWRARDKNGQEGYIPSNYVTEAEDSIEMYEWYSKHMTRSQAEQLLKQEGKEGGFIVRDSSKAGKYTVSVFAKSTGDPQGVIRHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDVAIKMIKEGSMSEDEFIEEAKVMMNLSHEKLVQLYGVCTKQRPIFIITEYMANGCLLNYLREMRHRFQTQQLLEMCKDVCEAMEYLESKQFLHRDLAARNCLVNDQGVVKVSDFGLSRYVLDDEYTSSVGSKFPVRWSPPEVLMYSKFSSKSDIWAFGVLMWEIYSLGKMPYERFTNSETAEHIAQGLRLYRPHLASEKVYTIMYSCWHEKADERPTFKILLSNILDVMDEES

SEQ ID NO: 845843 - protein, 648 aa, Homo sapiens
MAAVILESIFLKRSQQKKKTSPLNFKKRLFLLTVHKLSYYEYDFERGRRGSKKGSIDVEKITCVETVVPEKNPPPERQIPRRGEESSEMEQISIIERFPYPFQVVYDEGPLYVFSPTEELRKRWIHQLKNVIRYNSDLVQKYHPCFWIDGQYLCCSQTAKNAMGCQILENRNGSLKPGSSHRKTKKPLPPTPEEDQILKKPLPPEPAAAPVSTSELKKVVALYDYMPMNANDLQLRKGDEYFILEESNLPWWRARDKNGQEGYIPSNYVTEAEDSIEMYEWYSKHMTRSQAEQLLKQEGKEGGFIVRDSSKAGKYTVSVFAKSTGDPQGVIRHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDVAIKMIKEGSMSEDEFIEEAKVMMNLSHEKLVQLYGVCTKQRPIFIITEYMANGCLLNYLREMRHRFQTQQLLEMCKDVCEAMEYLESKQFLHRDLAARNCLVNDQGVVKVSDFGLSRYVLDDEYTSSVGSKFPVRWSPPEVLMYSKFSSKSDIWAFGVLMWEIYSLGKMPYERFTNSETAEHIAQGLRLYRPHLASEKVYTIMYSCWHEVSALLGSLKLFP

SEQ ID NO: 845844 - protein, 659 aa, Homo sapiens
MAAVILESIFLKRSQQKKKTSPLNFKKRLFLLTVHKLSYYEYDFERGRRGSKKGSIDVEKITCVETVVPEKNPPPERQIPRRGEESSEMEQISIIERFPYPFQVVYDEGPLYVFSPTEELRKRWIHQLKNVIRYNSDLVQKYHPCFWIDGQYLCCSQTAKNAMGCQILENRNGSLKPGSSHRKTKKPLPPTPEEDQILKKPLPPEPAAAPVSTSELKKVVALYDYMPMNANDLQLRKGDEYFILEESNLPWWRARDKNGQEGYIPSNYVTEAEDSIEMYEWYSKHMTRSQAEQLLKQEGKEGGFIVRDSSKAGKYTVSVFAKSTGDPQGVIRHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDVAIKMIKEGSMSEDEFIEEAKVMMNLSHEKLVQLYGVCTKQRPIFIITEYMANGCLLNYLREMRHRFQTQQLLEMCKDVCEAMEYLESKQFLHRDLAARNCLVNDQGVVKVSDFGLSRYVLDDEYTSSVGSKFPVRWSPPEVLMYSKFSSKSDIWAFGVLMWEIYSLGKMPYERFTNSETAEHIAQGLRLYRPHLASEKVYTIMYSCWHEKADERPTFKILLSNILDVMDEES

SEQ ID NO: 845845 - protein, 112 aa, Homo sapiens
MASWSIQQMVIGCPLCGRHCSGGEHTGELQKEEAMAAVILESIFLKRSQQKKKTSPLNFKKRLFLLTVHKLSYYEYDFERGKRGNKKGSEMLKKSLCSNSESWNLLHKAIVW

SEQ ID NO: 845846 - protein, 525 aa, Homo sapiens [sequence omitted]

SEQ ID NO: 845847 - protein, 119 aa, Homo sapiens
MQHCPGPSSCSFRGLPPPPAREWGLTRAGGLTLSPPAPSKSTLTTWTLTKSMLLPYLLAVGLRAPPANISAPLKMDPTCPRQKPPAWFWSAPSQRAGSCYTLTDTRTPASLRKRSDNRA

SEQ ID NO: 845848 - protein, 523 aa, Homo sapiens
FCMHHGRRWSVREEGGELAGPRGGDGGGGGLRRPERRRWRRRPRRLGVFGRAAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEARAGTMWRRWPSPPPSPDPGPRPGTMMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSSSVPPAINSIGSNANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQNQL

SEQ ID NO: 845849 - protein, 482 aa, Homo sapiens
PVLGLEHANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEAKDPPAVENYPPPPAPAPTDGSEPAPAPVADGDIPSQFTRVMGKVCTQLLVSRPDEENITSYLQLIEKCLTHEAFTETQKKRLLSWKQQVLKLLRTFPRKAALEMQNYRQQKGWAFGSNSLPIAGSVGMGVARRTQRQFPMPPRALPPGRMGLLSPSGIGGVSPRHALTSPSLGGQGRQNLWFANPGGSNSMPSQSRSSVQRTHSLPVHSSPQAILMFPPDCPVPGPDLEINPTLESLCLSMTEHALGDGTDKTSTI

SEQ ID NO: 845850 - protein, 406 aa, Homo sapiens
FCMHHGRRWSVREEGGELAGPRGGDGGGGGLRRPERRRWRRRPRRLGVFGRAAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEARAGTMWRRWPSPPPSPDPGPRPGTMMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSNR

SEQ ID NO: 845851 - protein, 475 aa, Homo sapiens
PVLGLEHANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEAKDPPAVENYPPPPAPAPTDGSEPAPAPVADGDIPSQFTRVMGKVCTQLLVSRPDEENITSYLQLIEKCLTHEAFTETQKKRLLSWKQQVLKLLRTFPRKAALEMQNYRQQKGWAFGSNSLPIAGSVGMGVARRTQRQFPMPPRALPPGRMGLLSPSGIGGVSPRHALTSPSLGGQGRQNLWFANPGGSNSMPSQSRSSVQRTHSLPVHSSPQAILMFPPGEVPHPWDSAWPTSSADLSFFSWVSCPLFF

SEQ ID NO: 845852 - protein, 37 aa, Homo sapiens
MRLLQKVLAYSIESNAFIEESRQLLSYALIHPATTLE

SEQ ID NO: 845853 - protein, 90 aa, Homo sapiens
MASELAMSNSDMPTSPLAMEYVNDFDLMKFEVNKEPVETVRIISQCGRLIAGGSLSSTPMSTPYRWVPPSPSFSAPSRVWGRQQTALLEE

SEQ ID NO: 845854 - protein, 458 aa, Homo sapiens
PVLGLEHANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEASSRDHVTALALATAVPRPWPQARHHDVPDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSNR

SEQ ID NO: 845855 - protein, 482 aa, Homo sapiens; identical to SEQ ID NO: 845849

SEQ ID NO: 845856 - protein, 480 aa, Homo sapiens
PVLGLEHANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEAKDPPAVENYPPPPAPAPTDGSEPAPAPVADGDIPSQFTRVMGKVCTQLLVSRPDEENITSYLQLIEKCLTHEAFTETQKKRLLSWKQQVLKLLRTFPRKAALEMQNYRQQKGWAFGSNSLPIAGSVGMGVARRTQRQFPMPPRALPPGRMGLLSPSGIGGVSPRHALTSPSLGGQGRQNLWFANPGGSNSMPSQSRSSVQRTHSLPVHSSPQAILMFPPDCPVPGPDLEINPTLESLCLSMTEHALGGEHFLFP

SEQ ID NO: 845857 - protein, 78 aa, Homo sapiens
SAKRGGGRAKRTPGAQSSGRGSFLASARRVGSWLVSAEGVGGPAPSLLPRQTTVGAGAGGEPGNRGPKMGVLAYSLHL

SEQ ID NO: 845858 - protein, 106 aa, Homo sapiens
QPLPGGGGEPAVGAGAGREVFIYLFATASAKRGGGRAKRTPGAQSSGRGSFLASARRVGSWLVSAEGVGGPAPSLLPRQTTVGAGAGGEPGNRGPKMGVLAYSLHL

SEQ ID NO: 845859 - protein, 298 aa, Homo sapiens [sequence omitted]

SEQ ID NO: 845860 - protein, 191 aa, Homo sapiens
MEEKQILCVGLVVLDVISLVDKYPKEDSEIRCLSQRWQRGGNASNSCTILSLLGAPCAFMGSMAPGHVADFLVADFRRRGVDVSQVAWQSKGDTPSSCCIINNSNGNRTIVLHDTSLPDVSATDFEKVDLTQFKWIHIEGRNASEQVKMLQRIDAHNTRQPPEQKIRVSVEVEKPREELFQLFGYGDVQVQ

SEQ ID NO: 845861 - protein, 298 aa, Homo sapiens [sequence omitted]

SEQ ID NO: 845862 - protein, 298 aa, Homo sapiens [sequence omitted]

SEQ ID NO: 845863 - protein, 298 aa, Homo sapiens [sequence omitted]

SEQ ID NO: 845864 - protein, 343 aa, Homo sapiens [sequence omitted]

SEQ ID NO: 845865 - protein, 253 aa, Homo sapiens [sequence omitted]

SEQ ID NO: 845866 - protein, 214 aa, Homo sapiens
MEEKQILCVGLVVLDVISLVDKYPKEDSEIRSLPDVSATDFEKVDLTQFKWIHIEGRNASEQVKMLQRIDAHNTRQPPEQKIRVSVEVEKPREELFQLFGYGDVVFVSKDVAKHLGFQSAEEALRGLYGRVRKGAVLVCAWAEEGADALGPDGKLLHSDAFPPPRVVDTLGAGDTFNASVIFSLSQGRSVQEALRFGCQVAGKKCGLQGFDGIV

SEQ ID NO: 845867 - protein, 236 aa, Homo sapiens
MEEKQILCVGLVVLDVISLVDKYPKEDSEIRCLSQRWQRGGNASNSCTILSLLGAPCAFMGSMAPGHVADFVLDDLRRYSVDLRYTVFQTTGSVPIATVIINEASGSRTILYYDSFLVADFRRRGVDVSQVAWQSKGDTPSSCCIINNSNGNRTIVLHDTSLPDVSATDFEKVDLTQFKWIHIEGRNASEQVKMLQRIDAHNTRQPPEQKIRVSVEVEKPREELFQLFGYGDVQVQ

SEQ ID NO: 845868 - protein, 187 aa, Homo sapiens
MEEKQILCVGLVVLDVISLVDKYPKEDSEIRCLSQRWQRGGNASNSCTILSLLGAPCAFMGSMAPGHVADFVLDDLRRYSVDLRYTVFQTTGSVPIATVIINEASGSRTILYYDRSLPDVSATDFEKVDLTQFKWIHIEGRNASEQVKMLQRIDAHNTRQPPEQKIRVSVEVLCLSVKSALGKEACV

SEQ ID NO: 845869 - protein, 298 aa, Homo sapiens [sequence omitted]

SEQ ID NO: 845870 - protein, 298 aa, Homo sapiens [sequence omitted]

SEQ ID NO: 845871 - protein, 217 aa, Homo sapiens
MEEKQILCVGLVVLDVISLVDKYPKEDSEIRCLSQRWQRGGNASNSCTILSLLGAPCAFMGSMAPGHVADFVLDDLRRYSVDLRYTVFQTTGSVPIATVIINEASGSRTILYYDRSLPDVSATDFEKVDLTQFKWIHIEGRNASEQVKMLQRIDAHNTRQPPEQKIRVSVEVEKPREELFQLFGYGDVHKCDPGYRVLLSSGRSDLEHILELGPTPI

SEQ ID NO: 845872 - protein, 343 aa, Homo sapiens [sequence omitted]

SEQ ID NO: 845873 - protein, 343 aa, Homo sapiens [sequence omitted]

SEQ ID NO: 845874 - protein, 273 aa, Homo sapiens
QNRTLLLLEARVLQHPLPTPFGGPDHFQALICVSFPFPGPASTLSFLVADFRRRGVDVSQVAWQSKGDTPSSCCIINNSNGNRTIVLHDTSLPDVSATDFEKVDLTQFKWIHIEGRNASEQVKMLQRIDAHNTRQPPEQKIRVSVEVEKPREELFQLFGYGDVVFVSKDVAKHLGFQSAEEALRGLYGRVRKGAVLVCAWAEEGADALGPDGKLLHSDAFPPPRVVDTLGAGDTFNASVIFSLSQGRSVQEALRFGCQVAGKKCGLQGFDGIV

SEQ ID NO: 845875 - protein, 574 aa, Homo sapiens
LSTEGFGTSTPPRAVPLPKSSQAAHQRNCNSGWSPGPASLGVRGSVCPAICWWHLSLLPPPSVNPTLQKCSSPGAAQELSMRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 845876 - protein, 574 aa, Homo sapiens; identical to SEQ ID NO: 845875

SEQ ID NO: 845877 - protein, 480 aa, Homo sapiens
LSTEGFGTSTPPRAVPLPKSSQAAHQRNCNSGWSPGPASLGVRGSVCPAICWWHLSLLPPPSVNPTLQKCSSPGAAQELSMRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGSNLSHSCMLPACNLLYLPLLFY

SEQ ID NO: 845878 - protein, 412 aa, Homo sapiens
MFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 845879 - protein, 574 aa, Homo sapiens; identical to SEQ ID NO: 845875

SEQ ID NO: 845880 - protein, 122 aa, Homo sapiens
MHPEPLLNSTQSAPHHFPDSFQATPFCFNQSLIPGSPSNSSILSGSLDYSYSPVQLPSYAPENYNSPASLDTRTCGYPPEDHSYQHLSSHATHELPRTTPLGVLEDRKGDPQRIIPPGCATA

SEQ ID NO: 845881 - protein, 346 aa, Homo sapiens
RERGEEGESRSGGEGGRRARWSAEKAEKRDEGERAEGKDRRERGREFLGPGPFTRSVWQVPRRPRTGLAKPHRLLPGWLPDQGHAEVGACPEATPGQKNQKVYQGVRVKITVKELLQQRRAHQAASGGTRSGGSSVHLSDPVAPSSAGLYFEPEPISSTPNYLQRGEFSSCVSCEENSSCLDQIFDSYLQTEMHPEPLLNSTQSAPHHFPDSFQATPFCFNQSLIPGSPSNSSILSGSLDYSYSPVQLPSYAPENYNSPASLDTRTCGYPPEDHSYQHLSSHAQYSCFSSATTSICYCASCEAEDLDALQAAEYFYPSTDCVDFAPSAAATSDFYKRETNCDICYS

SEQ ID NO: 845882 - protein, 105 aa, Homo sapiens
MREYKVVVLGSGGVGKSALTVQFVTGTFIEKYDPTIEDFYRKEIEVDSSPSVLEILDTAGTEQFASMRDLYIKNGQGFILVYSLVNQQSFQDIKPMRDQIIRVKR

SEQ ID NO: 845883 - protein, 183 aa, Homo sapiens
MREYKVVVLGSGGVGKSALTVQFVTGTFIEKYDPTIEDFYRKEIEVDSSPSVLEILDTAGTEQFASMRDLYIKNGQGFILVYSLVNQQSFQDIKPMRDQIIRVKRYEKVPVILVGNKVDLESEREVSSSEGRALAEEWGCPFMETSAKSKTMVDELFAEIVRQMNYAAQPDKDDPCCSACNIQ

SEQ ID NO: 845884 - protein, 183 aa, Homo sapiens; identical to SEQ ID NO: 845883

SEQ ID NO: 845885 - protein, 67 aa, Homo sapiens
GGGCGILTLPLRDHRVLLPGISAIMAGACKEDEAMLHPHVPVCRNLTGQYEYLAFLSSLKQQIPSRL

SEQ ID NO: 845886 - protein, 82 aa, Homo sapiens
RAKHATRTGIEAIPLVKPLSQGGRPLQARASWWALPAKDAINGVQTCRKGSWDANAPPMLSSSNSSSPWSSCRIRHELSVYV

SEQ ID NO: 845887 - protein, 183 aa, Homo sapiens; identical to SEQ ID NO: 845883

SEQ ID NO: 845888 - protein, 183 aa, Homo sapiens; identical to SEQ ID NO: 845883

SEQ ID NO: 845889 - protein, 326 aa, Homo sapiens
FPFFVLVLPAAFSMRFPLSAVCQTPKLMIHTSSPADHPDSPYAGANAGGKMAAGFKTVEPLEYYRRFLKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDDTLLIVDPTGEEEHLATGTLTIVMDEEGKLCCLHKPGGSGLTGAKLQDCMSRAVTRHKEVKKLMDEVIKSMKPK

SEQ ID NO: 845890 - protein, 325 aa, Homo sapiens
MRGRARDLSSRPHLGISRGVSGPGIRVESAAAEQARRRGAGRRRRAGGKMAAGFKTVEPLEYYRRFLKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDDTLLIVDPTGEEEHLATGTLTIVMDEEGKLCCLHKPGGSGLTGAKLQDCMSRAVTRHKEVKKLMDEVIKSMKPK

SEQ ID NO: 845891 - protein, 325 aa, Homo sapiens; identical to SEQ ID NO: 845890

SEQ ID NO: 845892 - protein, 300 aa, Homo sapiens
MRGRARDLSSRPHLGISRGVSGPGIRVESAAAEQARRRGAGRRRRAGGKMAAGFKTVEPLEYYRRFLKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDDTLLIVDPTGEEEHLATGTLTIVMDEEGKLCCLHKPDQACSRHFSPKHM

SEQ ID NO: 845893 - protein, 347 aa, Homo sapiens
MMPGRVGALQCEKTYKSLSTQRDKIPRENERTEEKESETPGNSEVRNLGESRGKGTSPRTGSAEEGTPEEPQSPGERTVEPLEYYRRFLKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDDTLLIVDPTGEEEHLATGTLTIVMDEEGKLCCLHKPGGSGLTGAKLQDCMSRAVTRHKEVKKLMDEVIKSMKPK

SEQ ID NO: 845894 - protein, 120 aa, Homo sapiens
MRGRARDLSSRPHLGISRGVSGPGIRVESAAAEQARRRGAGRRRRAGGKMAAGFKTVEPLEYYRRFLKENCRPDGRELGEFRTTTVNIGSISTADGSALVKLGNTTVICGVKAVSLNMSY

SEQ ID NO: 845895 - protein, 120 aa, Homo sapiens; identical to SEQ ID NO: 845894

SEQ ID NO: 845896 - protein, 227 aa, Homo sapiens
MEENLVNSEPQLSTSEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDDTLLIVDPTGEEEHLATGTLTIVMDEEGKLCCLHKPGGSGLTGAKLQDCMSRAVTRHKEVKKLMDEVIKSMKPK

SEQ ID NO: 845897 - protein, 259 aa, Homo sapiens
MRGRARDLSSRPHLGISRGVSGPGIRVESAAAEQARRRGAGRRRRAGGKMAAGFKTVEPLEYYRRFLKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDEWKWANWS

SEQ ID NO: 845898 - protein, 249 aa, Homo sapiens
MRGRARDLSSRPHLGISRGVSGPGIRVESAAAEQARRRGAGRRRRAGGKMAAGFKTVEPLEYYRRFLKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNGGSGLTGAKLQDCMSRAVTRHKEVKKLMDEVIKSMKPK

SEQ ID NO: 845899 - protein, 154 aa, Homo sapiens
MRGRARDLSSRPHLGISRGVSGPGIRVESAAAEQARRRGAGRRRRAGGKMAAGFKTVEPLEYYRRFLKENCRPDGRELGEFRTTTVNIGSISTADGSALVKLGNTTVICGVKAEFAAPSTDAPDKGYVDSGLDLLEKRPKWLASSLQMSLKIHR

SEQ ID NO: 845900 - protein, 325 aa, Homo sapiens; identical to SEQ ID NO: 845890

SEQ ID NO: 845901 - protein, 325 aa, Homo sapiens; identical to SEQ ID NO: 845890

SEQ ID NO: 845902 - protein, 300 aa, Homo sapiens; identical to SEQ ID NO: 845892

SEQ ID NO: 845903 - protein, 276 aa, Homo sapiens
MGAGFKTVEPLEYYRRFLKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDDTLLIVDPTGEEEHLATGTLTIVMDEEGKLCCLHKPGGSGLTGAKLQDCMSRAVTRHKEVKKLMDEVIKSMKPK

SEQ ID NO: 845904 - protein, 313 aa, Homo sapiens
MRGRARDLSFASPPWHFPWRERPRHPCRKCGGGTGAQERSGQAQTRGREDGGWVQKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDDTLLIVDPTGEEEHLATGTLTIVMDEEGKLCCLHKPGGSGLTGAKLQDCMSRAVTRHKEVKKLMDEVIKSMKPK

SEQ ID NO: 845905 - protein, 113 aa, Homo sapiens
MRGRARDLSSRPHLGISRGVSGPGIRVESAAAEQARRRGAGRRRRAGGKMAAGFKTVEPLEYYRRFLKENCRPDGRELGEFRTTTVNIGSISTADGSALVKLGNTTVICGVKA

SEQ ID NO: 845906 - protein, 120 aa, Homo sapiens; identical to SEQ ID NO: 845894

SEQ ID NO: 845907 - protein, 188 aa, Homo sapiens
MGAGFKTVEPLEYYRRFLKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKTLCL

SEQ ID NO: 845908 - protein, 159 aa, Homo sapiens
AGFQEGAAFAQRETAGRRVGQRWCGDCFRTPGTALGGSWPQTSVFSAAVKARGCRIATLPMDLIGFGYAALVTFGSIFGYKRRGGVPSLIAGLFVGCLAGYGAYRVSNDKRDVKVSLFTAFFLATIMGVRFKRSKKIMPAGLVAGLSLMMILRLVLLLL

SEQ ID NO: 845909 - protein, 93 aa, Homo sapiens
LPDSRYRAWATAPQTSVFSAAVKARGCRLECSGTALVRRLLPDSRYRAWRQLAPDFCLFSCSEGSGLQNCNLANGPDRFWLCSPRDIWKHFWI

SEQ ID NO: 845910 - protein, 159 aa, Homo sapiens; identical to SEQ ID NO: 845908

SEQ ID NO: 845911 - protein, 159 aa, Homo sapiens; identical to SEQ ID NO: 845908

SEQ ID NO: 845912 - protein, 112 aa, Homo sapiens [sequence omitted]

SEQ ID NO: 845913 - protein, 159 aa, Homo sapiens; identical to SEQ ID NO: 845908

SEQ ID NO: 845914 - protein, 200 aa, Homo sapiens
AGFQEGAAFAQRETAGRRVGQRWCGDCFRTPGTALGGSWPQTSVFSAAVKARGCRIATLPMDLIGFGYAALVTFGSIFGYKRRGGVPSLIAGLFVGCLAGYGAYRVSNDKRDVKVSLFTAFFLATIMGVRFKRSTLVLLLLLTILRTSLLTLSYPSSPVLSILLSAFFTSPLNLFSLLTHFQLFTFNYDPLSSRHPSLPS

SEQ ID NO: 845915 - protein, 93 aa, Homo sapiens; identical to SEQ ID NO: 845909

SEQ ID NO: 845916 - protein, 159 aa, Homo sapiens; identical to SEQ ID NO: 845908

SEQ ID NO: 845917 - protein, 136 aa, Homo sapiens
SGFPGGSGLCSARDGWAPSGTALVRRLLPDSRIATLPMDLIGFGYAALVTFGSIFGYKRRGGVPSLIAGLFVGCLAGYGAYRVSNDKRDVKVSLFTAFFLATIMGVRFKRSKKIMPAGLVAGLSLMMILRLVLLLL

SEQ ID NO: 845918 - protein, 177 aa, Homo sapiens
SGLQVPRLGDCAPDFCLFSCSEGSGLQAGVQWDSAGAETASGLQVPRLAAAGPRLLSFPGPPFGGPGKARGCRIATLPMDLIGFGYAALVTFGSIFGYKRRGGVPSLIAGLFVGCLAGYGAYRVSNDKRDVKVSLFTAFFLATIMGVRFKRSKKIMPAGLVAGLSLMMILRLVLLLL

SEQ ID NO: 845919 - protein, 147 aa, Homo sapiens
AGFQEGAAFAQRETAGRRVGQRWCGDCFRTPGTALGGSWPQTSVFSAAVKARGCRIATLPMDLIGFGYAALVTFGSIFGYKRRGGVPSLIAGLFVGCLAGYGAYRVSNDKRDVKVSLFTAFFLATIMGVRFKRSKKIMPAGLVAGLR

SEQ ID NO: 845920 - protein, 256 aa, Homo sapiens [sequence omitted]

SEQ ID NO: 845921 - protein, 141 aa, Homo sapiens
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERSRSF

SEQ ID NO: 845922 - protein, 141 aa, Homo sapiens; identical to SEQ ID NO: 845921

SEQ ID NO: 845923 - protein, 133 aa, Homo sapiens [sequence omitted]

SEQ ID NO: 845924 - protein, 283 aa, Homo sapiens
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERVTTLAGAQQELLNMKLWTIHELLQDSKPDKDMEASEPGEGSGGESAGGGDKVSETGTFLISPHTEASRPLPEDFCLKEDEEEVGDSQAWEEPTNWSTETWNLATSWEVGRGLRRRCSQAVAKGPSHSLGWEGGTTAEGRLKQSLFS

SEQ ID NO: 845925 - protein, 190 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLARVREPMWLPLLMLEVACCLPGAG

SEQ ID NO: 845926 - protein, 737 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 845927 - protein, 809 aa, Homo sapiens
RARKGLVLIRRGLLPRSQRFGAGVRSCNRKPSVLQASRRAPATRPRTLPGAFPRHLRGPYLEIPGAPLPAPAMPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 845928 - protein, 737 aa, Homo sapiens; identical to SEQ ID NO: 845926

SEQ ID NO: 845929 - protein, 675 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 845930 - protein, 737 aa, Homo sapiens; identical to SEQ ID NO: 845926

SEQ ID NO: 845931 - protein, 737 aa, Homo sapiens; identical to SEQ ID NO: 845926

SEQ ID NO: 845932 - protein, 755 aa, Homo sapiens
MPLNRTLSMSSLPGLEDWEDEFDLENAVLFEVAWEVANKGPRTMDLGRGLPYTLGPTVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 845933 - protein, 737 aa, Homo sapiens; identical to SEQ ID NO: 845926

SEQ ID NO: 845934 - protein, 740 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 845935 - protein, 737 aa, Homo sapiens; identical to SEQ ID NO: 845926

SEQ ID NO: 845936 - protein, 661 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRVGPPLSYPLLANQQLLARGLWCRVQGLILLVTVAVPLSNEPGRSRWWLMVVIPALWEA

SEQ ID NO: 845937 - protein, 624 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYAYHPAEPHGAPLRPSGLEIPRPVLYVCAPHGAVQGLSRALHLRAQRGGCGPGVPLPTASLGATVALAVTTLQPAPE

SEQ ID NO: 845938 - protein, 77 aa, Homo sapiens
LVPQSPGDHEDLPRMFSEPGSWPPQVSTFLTGGSAAWMIPARSSPPSSTVSVSRAGGSVSSSGTARSASPTFWTGNT

SEQ ID NO: 845939 - protein, 110 aa, Homo sapiens
CGDLEDPSTARTLPGAFPRHLRGPYLEIPGAPLPAPAMPLNRTLSMSSLPGLEDWEDEFDLENAVLFEVAWEVANKVGGIYTVLQTKAKVTGDEWGDNYFLVGPWIRQIL

SEQ ID NO: 845940 - protein, 675 aa, Homo sapiens; identical to SEQ ID NO: 845929

SEQ ID NO: 845941 - protein, 737 aa, Homo sapiens; identical to SEQ ID NO: 845926

SEQ ID NO: 845942 - protein, 737 aa, Homo sapiens; identical to SEQ ID NO: 845926

SEQ ID NO: 845943 - protein, 740 aa, Homo sapiens; identical to SEQ ID NO: 845934

SEQ ID NO: 845944 - protein, 721 aa, Homo sapiens
GTRDRFKGMAGAEKGGSGEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 845945 - protein, 495 aa, Homo sapiens
MVRGWVLNRPRVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 845946 - protein, 322 aa, Homo sapiens [sequence omitted]

SEQ ID NO: 845947 - protein, 144 aa, Homo sapiens
ISSVPLFSRVGRTVDSLISPGFVRMLCRSCEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 845948 - protein, 377 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNAASRRCCLLHHACEPMRDPLD

SEQ ID NO: 845949 - protein, 132 aa, Homo sapiens
PGVGVGPGGRRPTLRVRIRALAPLDARPAPVAVMAATICRALAKSRAARHRRPVSLRQQPGVTGRIRNPILQNRISGPKELCPRSHSSREPEAGFKTASPYSRYCSLTRCPRLPHVGSLTKLRGPRFPQEGY

SEQ ID NO: 845950 - protein, 1226 aa, Homo sapiens
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWYSWCSQRLVEERYSWTSQLSPADLIPLEVPTGASSPTQRDWQEQLVVGHNVSFDRAHIREQYLIQGSRMRFLDTMSMHMAISGLSSFQRSLWIAAKQGKHKVQPPTKQGQKSQRKARRGPAISSWDWLDISSVNSLAEVHRLYVGGPPLEKEPRELFVKGTMKDIRENFQDLMQYCAQDVWATHEVFQQQLPLFLERCPHPVTLAGMLEMGVSYLPVNQNWERYLAEAQGTYEELQREMKKSLMDLANDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMDTYLGWLPSALLRASWLGLLGAWAAGQPGQAADRYHPGVSWGGLPLQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMISFWRNAHKRISSQMVVWLPRSALPRAVIRHPDYDEEGLYGAILPQVVTAGTITRRAVEPTWLTASNARPDRVGSELKAMVQAPPGYTLVGADVDSQELWIAAVLGDAHFAGMHGCTAFGWMTLQGRKSRGTDLHSKTATTVGISREHAKIFNYGRIYGAGQPFAERLLMQFNHRLTQQEAAEKAQQMYAATKGLRWYRLSDEGEWLVRELNLPVDRTEGGWISLQDLRKVQRETARKSQWKKWEVVAERAWKGGTESEMFNKLESIATSDIPRTPVLGCCISRALEPSAVQEEFMTSRVNWVVQSSAVDYLHLMLVAMKWLFEEFAIDGRFCISIHDEVRYLVREEDRYRAALALQITNLLTRCMFAYKLGLNDLPQSVAFFSAVDIDRCLRKEVTMDCKTPSNPTGMERRYGIPQGEALDIYQIIELTKGSLEKRSQPGP

SEQ ID NO: 845951 - protein, 1168 aa, Homo sapiens [sequence omitted]

SEQ ID NO: 845952 - protein, 1168 aa, Homo sapiens [sequence omitted]

SEQ ID NO: 845953 - protein, 1168 aa, Homo sapiens [sequence omitted]

SEQ ID NO: 845954 - protein, 1035 aa, Homo sapiens
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWYSWCSQRLVEERYSWTSQLSPADLIPLEVPTGASSPTQRDWQEQLVVGHNVSFDRAHIREQYLIQGSRMRFLDTMSMHMAISGLSSFQRSLWIAAKQGKHKVQPPTKQGQKSQRKARRGPAISSWDWLDISSVNSLAEVHRLYVGGPPLEKEPRELFVKGTMKDIRENFQDLMQYCAQDVWATHEVFQQQLPLFLERCPHPVTLAGMLEMGVSYLPVNQNWERYLAEAQGTYEELQREMKKSLMDLANDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMALTWDGFPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMISFWRNAHKRISSQMVVWLPRSALPRAVIRHPDYDEEGLYGAILPQVVTAGTITRRAVEPTWLTASNARPDRVGSELKAMVQAPPGYTLVGADVDSQELWIAAVLGDAHFAGMHGCTAFGWMTLQGRKSRGTDLHSKTATTVGISREHAKIFNYGRIYGAGQPFAERLLMQFNHRLTQQEAAEKAQQMYAATKGLRWYRLSDEGEWLVRELNLPVDRTEGGWISLQDLRKVQRETARK

SEQ ID NO: 845955 - protein, 1239 aa, Homo sapiens
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWYSWCSQRLVEERYSWTSQLSPADLIPLEVPTGASSPTQRDWQEQLVVGHNVSFDRAHIREQYLIQGSRMRFLDTMSMHMAISGLSSFQRSLWIAAKQGKHKVQPPTKQGQKSQRKARRGPAISSWDWLDISSVNSLAEVHRLYVGGPPLEKEPRELFVKGTMKDIRENFQDLMQYCAQDVWATHEVFQQQLPLFLERCPHPVTLAGMLEMGVSYLPVNQNWERYLAEAQGTYEELQREMKKSLMDLANDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMALTWDGFPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMISFWRNAHKRISSQMVVWLPRSALPRAVIRHPDYDEEGLYGAILPQVVTAGTITRRAVEPTWLTASNARPDRVGSELKAMVQAPPGYTLVGADVDSQELWIAAVLGDAHFAGMHGCTAFGWMTLQGRKSRGTDLHSKTATTVGISREHAKIFNYGRIYGAGQPFAERLLMQFNHRLTQQEAAEKAQQMYAATKGLRWYRLSDEGEWLVRELNLPVDRTEGGWISLQDLRKVQRETARKSQWKKWEVVAERAWKGGTESEMFNKLESIATSDIPRTPVLGCCISRALEPSAVQEEFMTSRVNWVVQSSAVDYLHLMLVAMKWLFEEFAIDGRFCISIHDEVRYLVREEDRYRAALALQITNLLTRCMFAYKLGLNDLPQSVAFFSAVDIDRCLRKEVTMDCKTPSNPTGMERRYGIPQGEALDIYQIIELTKGSLEKRSQPGP

SEQ ID NO: 845956 - protein, 111 aa, Homo sapiens
IRLCSHACRQVGVSKHSCNPQLLGVHISTHKGVARVGLQGRKSRGTDLHSKTATTVGISREHAKIFNYGRIYGAGQPFAERLLMQFNHRLTQQEAAEKAQQMYAATKGLRW

SEQ ID NO: 845957 - protein, 1233 aa, Homo sapiens
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWYSWCSQRLVEERYSWTSQLSPADLIPLEVPTGASSPTQRDWQEQLVVGHNVSFDRAHIREQYLIQGSRMRFLDTMSMHMAISGLSSFQRSLWIAAKQGKHKVQPPTKQGQKSQRKARRGPAISSWDWLDISSVNSLAEVHRLYVGGPPLEKEPRELFVKGTMKDIRENFQDLMQYCAQDVWATHEVFQQQLPLFLERCPHPVTLAGMLEMGVSYLPVNQNWERYLAEAQGTYEELQREMKKSLMDLANDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMALTWDGFPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMISFWRNAHKRISSQMVVWLPRSALPRAVIRHPDYDEEGLYGAILPQVVTAGTITRRAVEPTWLTASNARPDRVGSELKAMVQAPPGYTLVGADVDSQELWIAAVLGDAHFAGMHGCTAFGWMTLQGRKSRGTDLHSKTATTVGISREHAKIFNYGRIYGAGQPFAERLLMQFNHRLTQQEAAEKAQQMYAATKGLRWYRLSDEGEWLVRELNLPVDRTEGGWISLQDLRKVQRETARKSQWKKWEVVAERAWKGGTESEMFNKLESIATSDIPRTPVLGCCISRALEPSAVQEEFMTSRVNWVVQSSAVDYLHLMLVAMKWLFEEFAISIHDEVRYLVREEDRYRAALALQITNLLTRCMFAYKLGLNDLPQSVAFFSAVDIDRCLRKEVTMDCKTPSNPTGMERRYGIPQGEALDIYQIIELTKGSLEKRSQPGP

SEQ ID NO: 845958 - protein, 815 aa, Homo sapiens
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWYSWCSQRLVEERYSWTSQLSPADLIPLEVPTGASSPTQRDWQEQLVVGHNVSFDRAHIREQYLIQGSRMRFLDTMSMHMAISGLSSFQRSLWIAAKQGKHKVQPPTKQGQKSQRKARRGPAISSWDWLDISSVNSLAEVHRLYVGGPPLEKEPRELFVKGTMKDIRENFQDLMQYCAQDVWATHEVFQQQLPLFLERCPHPVTLAGMLEMGVSYLPVNQNWERYLAEAQGTYEELQREMKKSLMDLANDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMALTWDGFPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMISFWRNAHKRISPLLSAY

SEQ ID NO: 845959 - protein, 1080 aa, Homo sapiens
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWYSWCSQRLVEERYSWTSQLSPADLIPLEVPTGASSPTQRDWQEQLVVGHNVSFDRAHIREQYLIQGSRMRFLDTMSMHMAISGLSSFQRSLWIAAKQGKHKVQPPTKQGQKSQRKARRGPAISSWDWLDISSVNSLAEVHRLYVGGPPLEKEPRELFVKGTMKDIRENFQDLMQYCAQDVWATHEVFQQQLPLFLERCPHPVTLAGMLEMGVSYLPVNQNWERYLAEAQGTYEELQREMKKSLMDLANDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMALTWDGFPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMISFWRNAHKRISSQMVVWLPRSALPRAVIRHPDYDEEGLYGAILPQVVTAGTITRRAVEPTWLTASNARPDRVGSELKAMVQAPPGYTLVGADVDSQELWIAAVLGDAHFAGMHGCTAFGWMTLQGRKSRGTDLHSKTATTVGISREHAKIFNYGRIYGAGQPFAERLLMQFNHRLTQQEAAEKAQQMYAATKGLRWYRLSDEGEWLVRELNLPVDRTEGGWISLQDLRKVQRETARKSQWKKWEVVAERAWKGGTESEMFNKLESIATSDIPRTPCPRRGKN

SEQ ID NO: 845960 - protein, 58 aa, Homo sapiens [sequence omitted]

SEQ ID NO: 845961 - protein, 101 aa, Homo sapiens
ILGPPSALQTCTFPVRAPAVLGPLTSPGLPLHPCFSPSSGSTFHMPLPSFPYDSLAAGSRVFWAYSLPALGEFRPLLSNHPLYPPALSPEDPSPRPAPGRR

SEQ ID NO: 845962 - protein, 122 aa, Homo sapiens
RARGHPSPGGDEAVPPGVSRRRVRLFSSRLRLPRLSFQVWFQNCRARHKKHTPQHPVPPSGAPPSRLPSALSDDIHYTPFSSPERARMVTLHGYIESHPFSVLTLPALPHLPVGAPQLPLSR

SEQ ID NO: 845963 - protein, 365 aa, Homo sapiens
PEGCRLPAEGGPATDQVMAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESHPFSVLTLPALPHLPVGAPQLPLSR

SEQ ID NO: 845964 - protein, 380 aa, Homo sapiens
PEGCRLPAEGGPATDQVMAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESQVQCGQVHCRLPYTAPPVHLKADMDGPLSNRGEKVILFQY

SEQ ID NO: 845965 - protein, 137 aa, Homo sapiens
RARGHPSPGGDEAVPPGVSRRRVRLFSSRLRLPRLSFQVWFQNCRARHKKHTPQHPVPPSGAPPSRLPSALSDDIHYTPFSSPERARMVTLHGYIESQVQCGQVHCRLPYTAPPVHLKADMDGPLSNRGEKVILFQY

SEQ ID NO: 845966 - protein, 286 aa, Homo sapiens
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQINKASPRRLPRKRAQKRSVGSDE

SEQ ID NO: 845967 - protein, 286 aa, Homo sapiens; identical to SEQ ID NO: 845966

SEQ ID NO: 845968 - protein, 286 aa, Homo sapiens; identical to SEQ ID NO: 845966

SEQ ID NO: 845969 - protein, 286 aa, Homo sapiens; identical to SEQ ID NO: 845966

SEQ ID NO: 845970 - protein, 286 aa, Homo sapiens; identical to SEQ ID NO: 845966

SEQ ID NO: 845971 - protein, 285 aa, Homo sapiens
LARTEDDRTHKPRCCAFYSLPRAPQSLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQINKASPRRLPRKRAQKRSVGSDE

SEQ ID NO: 845972 - protein, 218 aa, Homo sapiens
MRLLPRLLLLLLLVFPATVLFRGGPRGLLAVAQDLTEDEETVEDSIIEDEDDEAEVEEDEPTDLVEDKEEEDVSGEPEASPSADTTILFVKGEEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQINKASPRRLPRKRAQKRSVGSDE

SEQ ID NO: 845973 - protein, 286 aa, Homo sapiens; identical to SEQ ID NO: 845966

SEQ ID NO: 845974 - protein, 286 aa, Homo sapiens; identical to SEQ ID NO: 845966

SEQ ID NO: 845975 - protein, 286 aa, Homo sapiens; identical to SEQ ID NO: 845966

SEQ ID NO: 845976 - protein, 192 aa, Homo sapiens
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNVRSSKPSFCLS

SEQ ID NO: 845977 - protein, 286 aa, Homo sapiens; identical to SEQ ID NO: 845966

SEQ ID NO: 845978 - protein, 286 aa, Homo sapiens; identical to SEQ ID NO: 845966

SEQ ID NO: 845979 - protein, 286 aa, Homo sapiens; identical to SEQ ID NO: 845966

SEQ ID NO: 845980 - protein, 105 aa, Homo sapiens
MRLLPRLLLLLLLVFPATVLFRGGPRGLLAVAQDLTEDEETVEDSIIEDEDDEAEVEEDEPTDLVEDKEEEDVSGEPEASPSADTTILFVKGEATRVQKILLLNP

SEQ ID NO: 845981 - protein, 286 aa, Homo sapiens; identical to SEQ ID NO: 845966

SEQ ID NO: 845982 - protein, 286 aa, Homo sapiens; identical to SEQ ID NO: 845966

SEQ ID NO: 845983 - protein, 278 aa, Homo sapiens
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKIKLHQEGCPGNGHRRDQWDLMSKCSFVQQFGLYLTCPNIFRPDGN

SEQ ID NO: 845984 - protein, 218 aa, Homo sapiens; identical to SEQ ID NO: 845972

SEQ ID NO: 845985 - protein, 305 aa, Homo sapiens
SSGAARGGVVWTEKVKGEARPCRFSSGSPGGLMSRSGTDPQQRQQASEADAAAATFRANDHQHIRYNPLQDEWVLVSAHRMKRPWQGQVEPQLLKTVPRHDPLNPLCPGAIRANGEIFENKGAMMGCSNPHPHCQVWASSFLPDIAQREERSQQAYKSQHGEPLLMEYSRQELLRKMSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFS

SEQ ID NO: 845986 - protein, 86 aa, Homo sapiens
ILGLGTGWRLLPVGSASGPQAESQALIPDLASIMKKLLTKYDNLFETSFPQAQRDLTPEQAAERLRALPEVHYHLGQKDRETATIA

SEQ ID NO: 845987 - protein, 423 aa, Homo sapiens
MPAHRDQPLEQRPPRRDSLGSSGAYNSFSVLRHKIFSSGSPGGLMSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVCKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 845988 - protein, 331 aa, Homo sapiens
MKRPWQGQVEPQLLKTVPRHDPLNPLCPGAIRANGEVNPQYDSTFLFDNDFPALQPDAPSPGPSDHPLFQAKSARGVCKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 845989 - protein, 408 aa, Homo sapiens
MPAHRDQPLEQRPPRRDSLGSSGAYNSFSVLRHKIFSSGSPGGLMSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVCKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGEAFQVPIFSPNTISGLLGLSLVNCNLKGASLETVAGGSGQSRDAGTEGGAANLVKLHLQCAF

SEQ ID NO: 845990 - protein, 395 aa, Homo sapiens
MPAHRDQPLEQRPPRRDSLGSSGAYNSFSVLRHKIFSSGSPGGLMSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVCKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDGAPTGSEAGANWNHWQLHAHYYPPLLRSATVRKFMVGYEMLAQAQRDLTPEQAAERLRALPEVHYHLGQKDRETATIA

SEQ ID NO: 845991 - protein, 251 aa, Homo sapiens [sequence omitted]

SEQ ID NO: 845992 - protein, 251 aa, Homo sapiens [sequence omitted]

SEQ ID NO: 845993 - protein, 407 aa, Homo sapiens
MPAHRDQPLEQRPPRRDSLGSSGAYNSFSVLRHKIFSSGSPGGLMSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVCKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQVRTQNSLASP

SEQ ID NO: 845994 - protein, 203 aa, Homo sapiens
MMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 845995 - protein, 272 aa, Homo sapiens
MPAHRDQPLEQRPPRRDSLGSSGAYNSFSVLRHKIFSSGSPGGLMSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVCKVMCFHPWSDVTLPLMSVPEIRAVVDAWASVTEELGAQYPWVQVWASSFLPDIAQREERSQQAYKSQHGEPLLMEYSRQELLRKVGESQALCPQGVPNFLIP

SEQ ID NO: 845996 - protein, 166 aa, Homo sapiens
MPAHRDQPLEQRPPRRDSLGSSGAYNSFSVLRHKIFSSGSPGGLMSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGNLAPTAAGEEGG

SEQ ID NO: 845997 - protein, 412 aa, Homo sapiens
MPAHRDQPLEQRPPRRDSLGSSGAYNSFSVLRHKIFSSGSPGGLMSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVWELWISPLTTFKPELETQHWGSALPVAQPSPTSRLSFLPSPPSKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKKGATRSLEDGALRGHGRTTNSCVPGACGGEAERNRGREIYTPQGKTVTEYAHCKSVSYPGARCHDRGARDAKWPQHRNGEVITSRTDQAPQKERTSS

SEQ ID NO: 845998 - protein, 411 aa, Homo sapiens
SSGAARGGVVWTEKVKGEARPCRFSSGSPGGLMSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVCKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 845999 - protein, 423 aa, Homo sapiens; identical to SEQ ID NO: 845987

SEQ ID NO: 846000 - protein, 408 aa, Homo sapiens; identical to SEQ ID NO: 845989

SEQ ID NO: 846001 - protein, 423 aa, Homo sapiens; identical to SEQ ID NO: 845987

SEQ ID NO: 846002 - protein, 423 aa, Homo sapiens; identical to SEQ ID NO: 845987

SEQ ID NO: 846003 - protein, 465 aa, Homo sapiens
MPAHRDQPLEQRPPRRDSLGSSGAYNSFSVLRHKIFSSGSPGGLMSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVWELWISPLTTFKPELETQHWGSALPVAQPSPTSRLSFLPSPPSKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 846004 - protein, 251 aa, Homo sapiens [sequence omitted]

SEQ ID NO: 846005 - protein, 270 aa, Homo sapiens
MTLSTLCVLGPSEPTESKVMCFHPWSDVTLPLMSVPEIRAVVDAWASVTEELGAQYPWVQIFENKGAMMGCSNPHPHCQVWASSFLPDIAQREERSQQAYKSQHGEPLLMEYSRQELLRKERLVLTSEHWLVLVPFWATWPYQTLLLPRRHVRRLPELTPAERDDLASIMKKLLTKYDNLFETSFPYSMGWHGAPTGSEAGANWNHWQLHAHYYPPLLRSATVRKFMVGYEMLAQAQRDLTPEQAAERLRALPEVHYHLGQKDRETATIA

SEQ ID NO: 846006 - protein, 119 aa, Homo sapiens [sequence omitted]

SEQ ID NO: 846007 - protein, 174 aa, Homo sapiens
MPAHRDQPLEQRPPRRDSLGSSGAYNSFSVLRHKIFSSGSPGGLMSRSGTDPQQRQQASEADAAAATFRANDHQHIRYNPLQDEWVLVSAHRMKRPWQGQVEPQLLKTVPRHDPLNPLCPGAIRANGEVNPQYDSTFLFDNDFPALQPDAPSPGPSDHPLFQAKSARGVWLQRD

SEQ ID NO: 846008 - protein, 751 aa, Homo sapiens
MGPQGARRQAFLAFGDVTVDFTQKEWRLLSPAQRALYREVTLENYSHLVSLGILHSKPELIRRLEQGEVPWGEERRRRPGPCAGIYAEHVLRPKNLGLAHQRQQQLQFSDQSFQSDTAEGQEKEKSTKPMAFSSPPLRHAVSSRRRNSVVEIESSQGQRENPTEIDKVLKGIENSRWGAFKCAERGQDFSRKMMVIIHKKAHSRQKLFTCRECHQGFRDESALLLHQNTHTGEKSYVCSVCGRGFSLKANLLRHQRTHSGEKPFLCKVCGRGYTSKSYLTVHERTHTGEKPYECQECGRRFNDKSSYNKHLKAHSGEKPFVCKECGRGYTNKSYFVVHKRIHSGEKPYRCQECGRGFSNKSHLITHQRTHSGEKPFACRQCKQSFSVKGSLLRHQRTHSGEKPFVCKDCERSFSQKSTLVYHQRTHSGEKPFVCRECGQGFIQKSTLVKHQITHSEEKPFVCKDCGRGFIQKSTFTLHQRTHSEEKPYGCRECGRRFRDKSSYNKHLRAHLGEKRFFCRDCGRGFTLKPNLTIHQRTHSGEKPFMCKQCEKSFSLKANLLRHQWTHSGERPFNCKDCGRGFILKSTLLFHQKTHSGEKPFICSECGQGFIWKSNLVKHQLAHSGKQPFVCKECGRGFNWKGNLLTHQRTHSGEKPFVCNVCGQGFSWKRSLTRHHWRIHSKEKPFVCQECKRGYTSKSDLTVHERIHTGERPYECQECGRKFSNKSYYSKHLKRHLREKRFCTGSVGEASS

SEQ ID NO: 846009 - protein, 751 aa, Homo sapiens; identical to SEQ ID NO: 846008

SEQ ID NO: 846010 - protein, 622 aa, Homo sapiens [sequence omitted]

SEQ ID NO: 846011 - protein, 751 aa, Homo sapiens; identical to SEQ ID NO: 846008

SEQ ID NO: 846012 - protein, 558 aa, Homo sapiens
MVIIHKKAHSRQKLFTCRECHQGFRDESALLLHQNTHTGEKSYVCSVCGRGFSLKANLLRHQRTHSGEKPFLCKVCGRGYTSKSYLTVHERTHTGEKPYECQECGRRFNDKSSYNKHLKAHSGEKPFVCKECGRGYTNKSYFVVHKRIHSGEKPYRCQECGRGFSNKSHLITHQRTHSGEKPFACRQCKQSFSVKGSLLRHQRTHSGEKPFVCKDCERSFSQKSTLVYHQRTHSGEKPFVCRECGQGFIQKSTLVKHQITHSEEKPFVCKDCGRGFIQKSTFTLHQRTHSEEKPYGCRECGRRFRDKSSYNKHLRAHLGEKRFFCRDCGRGFTLKPNLTIHQRTHSGEKPFMCKQCEKSFSLKANLLRHQWTHSGERPFNCKDCGRGFILKSTLLFHQKTHSGEKPFICSECGQGFIWKSNLVKHQLAHSGKQPFVCKECGRGFNWKGNLLTHQRTHSGEKPFVCNVCGQGFSWKRSLTRHHWRIHSKEKPFVCQECKRGYTSKSDLTVHERIHTGERPYECQECGRKFSNKSYYSKHLKRHLREKRFCTGSVGEASS

SEQ ID NO: 846013 - protein, 751 aa, Homo sapiens; identical to SEQ ID NO: 846008

SEQ ID NO: 846014 - protein, 128 aa, Homo sapiens
MSLSWICREPGSLDLLARSPQGNCAGAPSPDPQLVLESHQLSHMGRAAAPSHPLTSLLPQIGHLQASLLRGEQEDSHGTSGSQETGFLGIWGCHCGFHPEGMEAAEPCSEGPVQGGDTGELQPPGLTR

SEQ ID NO: 846015 - protein, 745 aa, Homo sapiens [sequence omitted]

SEQ ID NO: 846016 - protein, 650 aa, Homo sapiens
MVGPGPTAAAAVEERQRKLQEYLAAKGKLKSQNTKPYLKSKNNCQNQPPSKSTIRPKNDVTNHVVLPVKPKRSISIKLQPRPPNTAGSQKPKLEPPKLLGKRLTSECVSSNPYSKPSSKSFQQCEAGSSTTGELSRKPVGSLNIEQLKTTKQQLTDQGNGKCIDFMNNIHVENESLDNFLKETNKENLLDILTEPERKPDPKLYTRSKPKTDSYNQTKNSLVPKQALGKSSVNSAVLKDRVNKQFVGETQSRTFPVKSQQLSSGADLARPGVKPSRTVPSHFIRTLSKVQSSKKPVVKNIKDIKVNRSQYERPNETKIRSYPVTEQRVKHTKPRTYPSLLQGEYNNRHPNIKQDQKSSQVCIPQTSCVLQKSKAISQRPNLTVGRFNSAIPSTPSIRPNGTSGNKHNNNGFQQKAQTLDSKLKKAVPQNHFLNKTAPKTQADVTTVNGTQTNPNIKKKATAEDRRKQLEEWQKSKGKTYKRPPMELKTKRKVIKEMNISFWKSIEKEEEEKKAQLELSSKINNTLTECLNLIEGGVPSNEILNILSSIPEAEKFAKFWICKAKLLASKGTFDVIGLYEEAIKNGATPIQELRKVVLNILQDSNRTTEGITSDSSVAETSITSKVPLLANNFALQIQSLANISASGSSLSL

SEQ ID NO: 846017 - protein, 648 aa, Homo sapiens
MVGPGPTAAAAVEERQRKLQEYLAAKGKLKSQNTKPYLKSKNNCQNQPPSKSTIRPKNDVTNHVVLPVKPKRSISIKLQPRPPNTAGSQKPKLEPPKLLGKRLTSECVSSNPYSKPSSKSFQQCEAGSSTTGELSRKPVGSLNIEQLKTTKQQLTDQGNGKCIDFMNNIHVENESLDNFLKETNKENLLDILTEPERKPDPKLYTRSKPKTDSYNQTKNSLVPKQALGKSSVNSAVLKDRVNKQFVGETQSRTFPVKSQQLSSGADLARPGVKPSRTVPSHFIRTLSKVQSSKKPVVKNIKDIKVNRSQYERPNETKIRSYPVTEQRVKHTKPRTYPSLLQGEYNNRHPNIKQDQKSSQVCIPQTSCVLQKSKAISQRPNLTVGRFNSAIPSTPSIRPNGTSGNKHNNNGFQQKAQTLDSKLKKAVPQNHFLNKTAPKTQADVTTVNGTQTNPNIKKKATAEDRRKQLEEWQKSKGKTYKRPPMELKTKRKVIKEMNISFWKSIEKEEEEKKAQLELSSKINNTLTECLNLIEGGVPSNEILNILSSIPEAEKFAKFWICKAKLLASKGTFDVIGLYEEAIKNGATPIQELRKVVLNILQDSNRTTEGTIIFEFKFIFSSCTSKNHPGHIGKRRKESSPEMLLTSWFP

SEQ ID NO: 846018 - protein, 389 aa, Homo sapiens
IILYEQQIGEFFYNQKGLREVLVFLDSHCEVNVMWLQPLLAAIREDRHTVVCPVIDIISADTLAYSSSPVVRGGFNWGLHFKWDLVPLSELGRAEGATAPIKSPTMAGGLFAMNRQYFHELGQYDSGMDIWGGENLEISFRIWMCGGKLFIIPCSRVGHIFRKRRPYGSPEGQDTMTHNSLRLAHVWLDEYKEQYFSLRPDLKTKSYGNISERVELRKKLGCKSFKWYLDNVYPEMQISGSHAKPQQPIFVNRGPKRPKVLQRGRLYHLQTNKCLVAQGRPSQKGGLVVLKACDYSDPNQIWIYNEEHELVLNSLLCLDMSETRSSDPPRLMKCHGSGGSQQWTFGKNNRLYQVSVGQCLRAVDPLGQKGSVAMAICDGSSSQQWHLEG

SEQ ID NO: 846019 - protein, 209 aa, Homo sapiens
MALAHVWLDEYKEQYFSLRPDLKTKSYGNISERVELRKKLGCKSFKWYLDNVYPEMQISGSHAKPQQPIFVNRGPKRPKVLQRGRLYHLQTNKCLVAQGRPSQKGGLVVLKACDYSDPNQIWIYNEEHELVLNSLLCLDMSETRSSDPPRLMKCHGSGGSQQWTFGKNNRLYQVSVGQCLRAVDPLGQKGSVAMAICDGSSSQQWHLEG

SEQ ID NO: 846020 - protein, 106 aa, Homo sapiens
MPRVRRIPAVDLWEKQSAIPGVGWTVPESSGSPGSEGLCRHGDLRWLLFTAVAFGRLRWMLWRERCFIRRCLRCGVWGFRKAWVGWSRTILEKMTVPCPPGDAWVC

SEQ ID NO: 846021 - protein, 118 aa, Homo sapiens [sequence omitted]

SEQ ID NO: 846022 - protein, 608 aa, Homo sapiens
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFYNEAFSALLRTVHSVIDRTPAHLLHEIILVDDDSDFDDLKGELDEYVQKYLPGKIKVIRNTKREGLIRGRMIGAAHATGEVLVFLDSHCEVNVMWLQPLLAAIREDRHTVVCPVIDIISADTLAYSSSPVVRGGFNWGLHFKWDLVPLSELGRAEGATAPIKSPTMAGGLFAMNRQYFHELGQYDSGMDIWGGENLEISFRIWMCGGKLFIIPCSRVGHIFRKRRPYGSPEGQDTMTHNSLRLAHVWLDEYKEQYFSLRPDLKTKSYGNISERVELRKKLGCKSFKWYLDNVYPEMQISGSHAKPQQPIFVNRGPKRPKVLQRGRLYHLQTNKCLVAQGRPSQKGGLVVLKACDYSDPNQIWIYNEEHELVLNSLLCLDMSETRSSDPPRLMKCHGSGGSQQWTFGKNNRLYQVSVGQCLRAVDPLGQKGSVAMAICDGSSSQQWHLEG

SEQ ID NO: 846023 - protein, 284 aa, Homo sapiens [sequence omitted]

SEQ ID NO: 846024 - protein, 557 aa, Homo sapiens
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFYNEAFSALLRTVHSVIDRTPAHLLHEIILVDDDSDFDDLKGELDEYVQKYLPGKIKVIRNTKREGLIRGRMIGAAHATGEVLVFLDSHCEVNVMWLQPLLAAIREDRHTVVCPVIDIISADTLAYSSSPVVRGGFNWGLHFKWDLVPLSELGRAEGATAPIKSPTMAGGLFAMNRQYFHELGQYDSGMDIWGGENLEISFRIWMCGGKLFIIPCSRVGHIFRKRRPYGSPEGQDTMTHNSLRLAHVWLDEYKEQYFSLRPDLKTKSYGNISERVELRKKLGCKSFKWYLDNVYPEMQISGSHAKPQQPIFVNRGPKRPKVLQRGRLYHLQTNKCLVAQGRPSQKGGLVVLKACDYSDPNQIWIYNEEHELVLNSLLCLDMCGLMSSFIGLMKVKAKLT

SEQ ID NO: 846025 - protein, 68 aa, Homo sapiens
FHCRGGVELAAAVGASGVNGWLLHPAAPSPLQDGALLVTWFPYGFERFSCVFILEFVSLLIWFGCVPT

SEQ ID NO: 846026 - protein, 409 aa, Homo sapiens
PPSPRSPSSPRAAQGMAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 846027 - protein, 409 aa, Homo sapiens; identical to SEQ ID NO: 846026

SEQ ID NO: 846028 - protein, 240 aa, Homo sapiens
PPSPRSPSSPRAAQGMAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLR

SEQ ID NO: 846029 - protein, 364 aa, Homo sapiens
MNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 846030 - protein, 374 aa, Homo sapiens
MAYLAWRLARRSCPSSLQVTSFPVVQLHMNRTAMRASQKDFENSMNQVKLLKKDPGNEVKLTGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 846031 - protein, 143 aa, Homo sapiens
PPSPRSPSSPRAAQGMAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKVSLLVTVLLFAVLLKKFVLLIKPL

SEQ ID NO: 846032 - protein, 251 aa, Homo sapiens
MAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLRNWGRQRIPKPDGGARALGGSDPLGYEPV

SEQ ID NO: 846033 - protein, 308 aa, Homo sapiens
MAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKKKKKKSFWAGGAEKVFKQPFFGGAGPFGVGTWAKRVQRESRAIQWGAWFPQIKKRGSTRGFLEHTSQVVVGGTPRAFTQGGQRSRLTRARGDSEKTRENHKTTEYNSYKEEEDNKQRRYKPNRQNLTQRNNSQEKQPTKKTRRENSMTN

SEQ ID NO: 846034 - protein, 409 aa, Homo sapiens; identical to SEQ ID NO: 846026

SEQ ID NO: 846035 - protein, 441 aa, Homo sapiens [sequence omitted]

SEQ ID NO: 846036 - protein, 143 aa, Homo sapiens; identical to SEQ ID NO: 846031

SEQ ID NO: 846037 - protein, 433 aa, Homo sapiens
PPSPRSPSSPRAAQGMAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEEELVIVATSYNRVEHSLFRVCEFQMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 846038 - protein, 143 aa, Homo sapiens; identical to SEQ ID NO: 846031

SEQ ID NO: 846039 - protein, 181 aa, Homo sapiens
MADPGNRGGIHRPLSFTCSLLIVGMCCVSPFFCHSQTDLLALSQADPQCWESSSVLLLEMWKPRVSNTVSGFWDFMIYLKSSENLKHGALFWDLAQLFWDIYVDCVLSRNHGLGRRQLVGEEEKISAAQPQHTRSKQGTYSQLLRTSFLKKKELIEDLISMHVRRSGSSVIGKVNLEIKRK

SEQ ID NO: 846040 - protein, 158 aa, Homo sapiens [sequence omitted]

SEQ ID NO: 846041 - protein, 168 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSIILLQSKR

SEQ ID NO: 846042 - protein, 168 aa, Homo sapiens; identical to SEQ ID NO: 846041

SEQ ID NO: 846043 - protein, 168 aa, Homo sapiens; identical to SEQ ID NO: 846041

SEQ ID NO: 846044 - protein, 168 aa, Homo sapiens; identical to SEQ ID NO: 846041

SEQ ID NO: 846045 - protein, 168 aa, Homo sapiens; identical to SEQ ID NO: 846041

SEQ ID NO: 846046 - protein, 168 aa, Homo sapiens; identical to SEQ ID NO: 846041

SEQ ID NO: 846047 - protein, 168 aa, Homo sapiens; identical to SEQ ID NO: 846041

SEQ ID NO: 846048 - protein, 138 aa, Homo sapiens
DLEDPIEHTLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSIILLQSKR

SEQ ID NO: 846049 - protein, 36 aa, Homo sapiens
MIIYTHSPPWYLLEVSRALSHSFENDELTERIKHLS

SEQ ID NO: 846050 - protein, 158 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFC

SEQ ID NO: 846051 - protein, 168 aa, Homo sapiens; identical to SEQ ID NO: 846041

SEQ ID NO: 846052 - protein, 239 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKEKEDAQSFALPVESGKFGRSNFKHS

SEQ ID NO: 846053 - protein, 104 aa, Homo sapiens
MKLLVWASAHQRKFHHFAIPSFCYSPKDEGLCSANVTRYYFNPRYRTCDAFTYTGCGGNDNNFVSREDCKRACAKALKKEKEDAQSFALPVESGKFGRSNFKHS

SEQ ID NO: 846054 - protein, 168 aa, Homo sapiens; identical to SEQ ID NO: 846041

SEQ ID NO: 846055 - protein, 168 aa, Homo sapiens; identical to SEQ ID NO: 846041

SEQ ID NO: 846056 - protein, 158 aa, Homo sapiens; identical to SEQ ID NO: 846050

SEQ ID NO: 846057 - protein, 239 aa, Homo sapiens; identical to SEQ ID NO: 846052

SEQ ID NO: 846058 - protein, 158 aa, Homo sapiens; identical to SEQ ID NO: 846050

SEQ ID NO: 846059 - protein, 158 aa, Homo sapiens; identical to SEQ ID NO: 846050

SEQ ID NO: 846060 - protein, 210 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSSRRAAESRAD

SEQ ID NO: 846061 - protein, 181 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVIDKHRYQLGF

SEQ ID NO: 846062 - protein, 168 aa, Homo sapiens; identical to SEQ ID NO: 846041

SEQ ID NO: 846063 - protein, 168 aa, Homo sapiens; identical to SEQ ID NO: 846041

SEQ ID NO: 846064 - protein, 168 aa, Homo sapiens; identical to SEQ ID NO: 846041

SEQ ID NO: 846065 - protein, 168 aa, Homo sapiens; identical to SEQ ID NO: 846041

SEQ ID NO: 846066 - protein, 168 aa, Homo sapiens; identical to SEQ ID NO: 846041

SEQ ID NO: 846067 - protein, 168 aa, Homo sapiens; identical to SEQ ID NO: 846041

SEQ ID NO: 846068 - protein, 168 aa, Homo sapiens; identical to SEQ ID NO: 846041

SEQ ID NO: 846069 - protein, 89 aa, Homo sapiens
EDPQLAWHRIEKVPKVCRLQVSVDDQCEGSTEKYFFNLSSMTCEKFFSGGCHRNRIENRFPDEATCMGFCAPKKIPSFCYSIILLQSKR

SEQ ID NO: 846070 - protein, 168 aa, Homo sapiens; identical to SEQ ID NO: 846041

SEQ ID NO: 846071 - protein, 239 aa, Homo sapiens; identical to SEQ ID NO: 846052

SEQ ID NO: 846072 - protein, 205 aa, Homo sapiens
MGLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKEKEDAQSFALPVESGKFGRSNFKHS

SEQ ID NO: 846073 - protein, 173 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTA

SEQ ID NO: 846074 - protein, 118 aa, Homo sapiens
DSLGHRPPGPGRFLENSTNNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTA

SEQ ID NO: 846075 - protein, 168 aa, Homo sapiens; identical to SEQ ID NO: 846041

SEQ ID NO: 846076 - protein, 158 aa, Homo sapiens; identical to SEQ ID NO: 846050

SEQ ID NO: 846077 - protein, 158 aa, Homo sapiens; identical to SEQ ID NO: 846050

SEQ ID NO: 846078 - protein, 307 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKKEKQKKKQKFLADIRPTAEKVCKKPIRALGGRQHPEWCKGEERHTARVTIEKKPRDKRPKGGDISHHKQENRAAVITPQVCGNQHPEGDRGEPKGEV

SEQ ID NO: 846079 - protein, 180 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSAHVTRYYFNPDD

SEQ ID NO: 846080 - protein, 289 aa, Homo sapiens
SSCLERPSNQLDWDVRSIQRWFRQRRNQEKPSTLTRLNEIMWRFSFYLYVFTYGVRFLKKTPWLWNTRHCWYNYPYQPLTTDLHYYYILELSFYWSLMFSQFTDIKRKDFGIMFLHHLVSIFLITFSYVNNMARVGTLVLCLHDSADALLEAAKMANYAKFQKMCDLLFVMFAVVFITTRLGIFPLWVLNTTLFESWEIVGPYPSWWVFNLLLLLVQGLNCFWSYLIVKIACKAVSRGKVSKDDRSDIESSSDEEDSEPPGKNPHTATTTNGTSGTNGYLLTGSCSMDD

SEQ ID NO: 846081 - protein, 289 aa, Homo sapiens; identical to SEQ ID NO: 846080

SEQ ID NO: 846082 - protein, 121 aa, Homo sapiens
MVDMMDLPRSRINAGMLAQFIDKPVCFVGRLEKIHPTGKMFILSDGEGKNGTIELMEPLDEEISGIVEVVGRVTAKATILCTSYVQFKEDSHPFDLGLYNEAVKIIHDFPQFYPLGIVQHD

SEQ ID NO: 846083 - protein, 121 aa, Homo sapiens; identical to SEQ ID NO: 846082

SEQ ID NO: 846084 - protein, 121 aa, Homo sapiens; identical to SEQ ID NO: 846082

SEQ ID NO: 846085 - protein, 121 aa, Homo sapiens; identical to SEQ ID NO: 846082

SEQ ID NO: 846086 - protein, 140 aa, Homo sapiens
MGTWTTSQRQWTCCCSTPTSDGLLGEPRLLHPCLSSTPASPPPLPLLHPPRRAPPPPPLPLLHPCLPSTCPSAQTNQGPDSPAFCPLPCMGRHLFPTWVACSPAWALTSAPCSEVQEGGTGLSGLWESPKSQNSPLTMGL

SEQ ID NO: 846087 - protein, 270 aa, Homo sapiens
MAPWGKRLAGVRGVLLDISGVLYDSGAGGGTAIAGSVEAVARLKRSRLKVRFCTNESQKSRAELVGQLQRLGFDISEQEVTAPAPAACQILKERGLRPYLLIHDGVRSEFDQIDTSNPNCVVIADAGESFSYQNMNNAFQVLMELEKPVLISLGKGRYYKETSGLMLDVGPYMKALEYACGIKAEVVGKPSPEFFKSALQAIGVEAHQAVMIGDDIVGDVGGAQRCGMRALQVRTGKFRPSDEHHPEVKADGYVDNLAEAVDLLLQHADK

SEQ ID NO: 846088 - protein, 270 aa, Homo sapiens; identical to SEQ ID NO: 846087

SEQ ID NO: 846089 - protein, 210 aa, Homo sapiens [sequence omitted]

SEQ ID NO: 846090 - protein, 100 aa, Homo sapiens
ENPGLAGMLSSLPPSLCQAGGKALAKAHKTPSHSRGTSSSRQSRLQVGWKGCAPDPRIARLSKTIPGCWPSDEHHPEVKADGYVDNLAEAVDLLLQHADK

SEQ ID NO: 846091 - protein, 107 aa, Homo sapiens
MGTWTTSQRQWTCCCSTPTSDGLLGEPRLLHPCLSTCPSAQTNQGPDSPAFCPLPCMGRHLFPTWVACSPAWALTSAPCSEVQEGGTGLSGLWESPKSQNSPLTMGL

SEQ ID NO: 846092 - protein, 426 aa, Homo sapiens
MAPWGKRLAGVRGVLLDISGVLYDSGAGGGTAIAGSVEAVARLKRSRLKVRFCTNESQKSRAELVGQLQRLGFDISEQEVTAPAPAACQILKERGLRPYLLIHDGVRSEFDQIDTSNPNCVVIADAGESFSYQNMNNAFQVLMELEKPVLISLGKGRYYKETSGLMLDVGPYMKALEYACGIKAEVVGKPSPEFFKSALQAIGVEAHQAVMIGDDIVGDVGGAQRCGMRALQVRTGKFRPSDEHHPEVKADGHFLALRGALSLAGADEPWCDACLGVGVAKKGGMTSFTPGSFRQPGHFQHVEGARALAETVWNRRPHAGLEFGAANGLRPCVQHMSRNCREKKTQDHRSGVLPGVFPTEAGSEQQPRPSHTSQARELPGQATVKGSRVGGGGEDRESRPLGPHPPLHLPALGPTQYQALGSMYHL

SEQ ID NO: 846093 - protein, 257 aa, Homo sapiens
MAPWGKRLAGVRGVLLDISGVLYDSGAGGGTAIAGSVEAVARLKRSRLKVRFCTNESQKSRAELVGQLQRLGFDISEQEVTAPAPAACQILKERGLRPYLLIHDGVRSEFDQIDTSNPNCVVIADAGESFSYQNMNNAFQVLMELEKPVLISLGKGRYYKETSGLMLDVGPYMKALEYACGIKAEVVGKPSPEFFKSALQAIGVEAHQAVMIGDDIVGDVGGAQRCGMRALQSRSTRVARHVLWTWCSHVLFSQDTP

SEQ ID NO: 846094 - protein, 249 aa, Homo sapiens
MLSSLPPSLCQAGGKALAKAHKTPSHSRGTSSSRQSRLQVGWKGCAPDPRIARLSKTIPGCWPSDEHHPEVKADGHFLALRGALSLAGADEPWCDACLGVGVAYEVRKTSFTPGSFRQPGHFQHVEGARALAETVWNRRPHAGLEFGAANGLRPCVQHMSRNCREKKTQDHRSGVLPGVFPTEAGSEQQPRPSHTSQARELPGQATVKGSRVGGGGEDRESRPLGPHPPLHLPALGPTQYQALGSMYHL

SEQ ID NO: 846095 - protein, 270 aa, Homo sapiens; identical to SEQ ID NO: 846087

SEQ ID NO: 846096 - protein, 87 aa, Homo sapiens
LRGELQLTQGRAAKSALQAMEWKPTAVMIGDDIVGDVGGAQRCGMRALQVRTGKFRPSDEHHPEVKADGYVDNLAEAVDLLLQHADK

SEQ ID NO: 846097 - protein, 134 aa, Homo sapiens
MGTWTTSQRQWTCCCSTPTSDGLLGEPRLLHPCLPPPLPLLHPPRRAPPPPPLPLLHPCLPSTCPSAQTNQGPDSPAFCPLPCMGRHLFPTWVACSPAWALTSAPCSEVQEGGTGLSGLWESPKSQNSPLTMGL

SEQ ID NO: 846098 - protein, 275 aa, Homo sapiens
MAPWGKRLAGVRGVLLDISGVLYDSGAGGGTAIAGSVEAVARLKRSRLKVRFCTNESQKSRAELVGQLQRLGFDISEQEVTAPAPAACQILKERGLRPYLLIHDGVRSEFDQIDTSNPNCVVIADAGESFSYQNMNNAFQVLMELEKPVLISLGKGRYYKETSGLMLDVGPYMKALEYACGIKAEVVGKPSPEFFKSALQAIGVEAHQAVMIGDDIVGDVGGAQRCGMRALQVRTGKFRSVPAGVIYSPSFQGMTTFSFCFVLQNKGDILSKSKS

SEQ ID NO: 846099 - protein, 169 aa, Homo sapiens
MAPWGKRLAGVRGVLLDISGVLYDSGAGGGTAIAGSVEAVARLKRSRLKVRFCTNESQKSRAELVGQLQRLGFDISEQEVTAPAPAACQILKERGLRPYLLIHDGVRSEFDQIDTSNPNCVVIADAGESFSYQNMNNAFQVLMELEKPVLISLGKGIHGFLFVARTFTS

SEQ ID NO: 846100 - protein, 144 aa, Homo sapiens
MDRFVWTSGLLEINETLVIQQRGVRIYDGEEKIKFDAGTLLLSTHRLIWRDQKNHECCMAILLSQIVFIEEQAAGIGKSAKIVVHLHPAPPNKEPGPFQSSKNSYIKLSFKEHGQIEVSFYMNKIVLERCVCVCVCVCVCVVAC

SEQ ID NO: 846101 - protein, 386 aa, Homo sapiens
MDRFVWTSGLLEINETLVIQQRGVRIYDGEEKIKFDAGTLLLSTHRLIWRDQKNHECCMAILLSQIVFIEEQAAGIGKSAKIVVHLHPAPPNKEPGPFQSSKNSYIKLSFKEHGQIEFYRRLSEEMTQRRWENMPVSQSLQTNRGPQPGRIRAVGIVGIERKLEEKRKETDKNISEAFEDLSKLMIKAKEMVELSKSIANKIKDKQGDITEDETIRFKSYLLSMGIANPVTRETYGSGTQYHMQLAKQLAGILQVPLEERGGIMSLTEVYCLVNRARGMELLSPEDLVNACKMLEALKLPLRLRVFDSGVMVIELQSHKEEEMVASALETVSEKGSLTSEEFAKLVGMSVLLAKERLLLAEKMGHLCRDDSVEGLRFYPNLFMTQS

SEQ ID NO: 846102 - protein, 386 aa, Homo sapiens; identical to SEQ ID NO: 846101

SEQ ID NO: 846103 - protein, 386 aa, Homo sapiens; identical to SEQ ID NO: 846101

SEQ ID NO: 846104 - protein, 253 aa, Homo sapiens [sequence omitted]

SEQ ID NO: 846105 - protein, 386 aa, Homo sapiens; identical to SEQ ID NO: 846101

SEQ ID NO: 846106 - protein, 386 aa, Homo sapiens; identical to SEQ ID NO: 846101

SEQ ID NO: 846107 - protein, 328 aa, Homo sapiens
MAILLSQIVFIEEQAAGIGKSAKIVVHLHPAPPNKEPGPFQSSKNSYIKLSFKEHGQIEFYRRLSEEMTQRRWENMPVSQSLQTNRGPQPGRIRAVGIVGIERKLEEKRKETDKNISEAFEDLSKLMIKAKEMVELSKSIANKIKDKQGDITEDETIRFKSYLLSMGIANPVTRETYGSGTQYHMQLAKQLAGILQVPLEERGGIMSLTEVYCLVNRARGMELLSPEDLVNACKMLEALKLPLRLRVFDSGVMVIELQSHKEEEMVASALETVSEKGSLTSEEFAKLVGMSVLLAKERLLLAEKMGHLCRDDSVEGLRFYPNLFMTQS

SEQ ID NO: 846108 - protein, 380 aa, Homo sapiens
MDRFVWTSGLLEINETLVIQQRGVRIYDGEEKIKFDAGTLLLSTHRLIWRDQKNHECCMAILLSQIVFIEEQAAGIGKSAKIVVHLHPAPPNKEPGPFQSSKNSYIKLSFKEHGQIEFYRRLSEEMTQRRWENMPVSQSLQTNRGPQPGRIRAVGIVGIERKLEEKRKETDKNISEAFEDLSKLMIKAKEMVELSKSIANKIKDKQGDITEDETIRFKSYLLSMGIANPVTRETYGSGTQYHMQLAKQLAGILQVPLEERGGIMSLTEVYCLVNRARGMELLSPEDLVNACKMLEALKLPLSGVMVIELQSHKEEEMVASALETVSEKGSLTSEEFAKLVGMSVLLAKERLLLAEKMGHLCRDDSVEGLRFYPNLFMTQS

SEQ ID NO: 846109 - protein, 354 aa, Homo sapiens
MDRFVWTSGLLEINETLVIQQRGVRIYDGEEKIKFDAGTLLLSTHRLIWRDQKNHECCMAILLSQIVFIEEQAAGIGKSAKIVVHLHPAPPNKEPGPFQSSKNSYIKLSFKEHGQIEFYRRLSEEMTQRRWENMPVSQSLQTNRGPQPGRIRAVGIVGIERKLEEKRKETDKNISEAFEDLSKLMIKAKEMVELSKSIANKIKDKQGDITEDETIRFKSYLLSMGIANPVTRETYGSGTQYHMQLAKQLAGILQVPLELLSPEDLVNACKMLEALKLPLSSCVTGSMTFVSRKNGAAGRSKGLLESVVGSGPTRGGRKGLAGPRRVPFDNGGDRRRGGGDTPIILYIETSPREK

SEQ ID NO: 846110 - protein, 491 aa, Homo sapiens
MEEGKMDENEWGYHGEGNKSLVVAHAQRCVVLRFLKFPPNRKKTSEEIFQHLQNIVDFGKNVMKEFLGENYVHYGEVVQLPLEFVKQLCLKIQSERPESRCDKDLDTLSGYAMCLPNLTRLQTYRFAEHRPILCVEIKPKCGFIPFSSDVTHEMKHKVCRYCMHQHLKVATGKWKQISKYCPLDLYSGNKQRMHFALKSLLQEAQNNLKIFKNGELIYGCKDARSPVADWSELAHHLKPFFFPSNGLASGPHCTRAVIRELVHVITRVLLSGSDKGRAGTLSPGLGPQGPRVCEASPFSRSLRCQGKNTPERSGLPKGCLLYKTLQVQMLDLLDIEGLYPLYNRVERYLEEFPEERKTLQIDGPYDEAFYQKLLDLSTEDDGTVAFALTKVQQYRVAMTAKDCSIMIALSPCLQDASSDQRPVVPSSRSRFAFSVSVLDLDLKPYESIPHQYKLDGKIVNYYSKTVRAKDNAVMSTRFKESEDCTLVLHKV

SEQ ID NO: 846111 - protein, 356 aa, Homo sapiens
MEEGKMDENEWGYHGEGNKSLVVAHAQRCVVLRFLKFPPNRKKTSEEIFQHLQNIVDFGKNVMKEFLGENYVHYGEVVQLPLEFVKQLCLKIQSERPESRCDKDLDTLSGYAMCLPNLTRLQTYRFAEHRPILCVEIKPKCGFIPFSSDVTHEMKHKVCRYCMHQHLKVATGKWKQISKYCPLDLYSGNKQRMHFALKSLLQEAQNNLKIFKNGELIYGCKDARSPVADWSELAHHLKPFFFPSNGLASGPHCTRAVIRELVHVITRVLLSGSDKGRAGTLSPGLGPQGPRVCEASPFSRSLRCQGKNTPERSGLPKGCLLYKTLQVQMLDLLDIEGLYPLYNRVERYLEEFPEER

SEQ ID NO: 846112 - protein, 172 aa, Homo sapiens
HDSTSIASESPWVAHDPGVLDQSPTSCWNGELIYGCKDARSPVADWSELAHHLKPFFFPSNGLASGPHCTRAVIRELVHVITRVLLSGSDKGRAGTLSPGLGPQGPRVCEASPFSRSLRCQGKNTPERSGLPKGCLLYKTLQVQMLDLLDIEGLYPLYNRVERYLEEFPEER

SEQ ID NO: 846113 - protein, 491 aa, Homo sapiens; identical to SEQ ID NO: 846110

SEQ ID NO: 846114 - protein, 356 aa, Homo sapiens; identical to SEQ ID NO: 846111

SEQ ID NO: 846115 - protein, 480 aa, Homo sapiens [sequence omitted]

SEQ ID NO: 846116 - protein, 203 aa, Homo sapiens
MGNIFEKLFKSLLGKKKMRILILSLDTAGKTTILYKLKLGETVPAVPTVGFCVETVEYKNNTFAVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVSYQLPSLHNSSRNYAGSPAQMMRHLLEA

SEQ ID NO: 846117 - protein, 176 aa, Homo sapiens
MGNIFEKLFKSLLGKKKMRILILSLDTAGKTTILYKLKLGETVPAVPTVGFCVETVEYKNNTFAVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVQ

SEQ ID NO: 846118 - protein, 177 aa, Homo sapiens
MGNIFEKLFKSLLGKKKMRILILSLDTAGKTTILYKLKLGETVPAVPTVGFCVETVEYKNNTFAVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVVK

SEQ ID NO: 846119 - protein, 132 aa, Homo sapiens
MGNIFEKLFKSLLGKKKMRILILSLDTAGKTTILYKLKLGETVPAVPTVGFCVETVEYKNNTFAVWDVGSHFKIRPLWQHFFQNTKGSCSIDQAGVQWRDLGSLQRPLPKLRAISFPVCTIHQEIMRGHRHK

SEQ ID NO: 846120 - protein, 125 aa, Homo sapiens; identical to SEQ ID NO: 772052

SEQ ID NO: 846121 - protein, 103 aa, Homo sapiens
MGNIFEKLFKSLLGKKKMRILILSLDTAGKTTILYKLKLGETVPAVPTVGFCVETVEYKNNTFAVWDVGSHFKIRPLWQHFFQNTKGKDYSVCSLDTVSVKCL

SEQ ID NO: 846122 - protein, 176 aa, Homo sapiens; identical to SEQ ID NO: 846117

SEQ ID NO: 846123 - protein, 177 aa, Homo sapiens; identical to SEQ ID NO: 846118

SEQ ID NO: 846124 - protein, 650 aa, Homo sapiens
MATALLAGEKLRELILPGAQDDKAGALAALLLQLKLELPFDRVVTIGTVLVPILLVTLVFTKNFAGWTLFSGSWDWLWGQNIKEPIYCYTPHNFTRDQALYARGYCWTELRDALPGVDASLWPSLFEHKFLPYALLAFAAIMYVPALGWEFLASTRLTSELNFLLQEIDNCYHRAAEGRAPKIEKQIQSKGPGITEREKREIIENAEKEKSPEQNLFEKYLERRGRSNFLAKLYLARHVLILLLSAVPISYLCTYYATQKQNEFTCALGASPDGAAGAGPAVRVSCKLPSVQLQRIIAGVDIVLLCVMNLIILVNLIHLFIFRKSNFIFDKLHKVGIKTRRQWRRSQFCDINILAMFCNENRDHIKSLNRLDFITNESDLMYDNVVRQLLAALAQSNHDATPTVRDSGVQTVDPSANPAEPDGAAEPPVVKRPRKKMKWIPTSNPLPQPFKEPLAIMRVENSKAEKPKPARRKTATDTLIAPLLDRSAHHYKGGGGDPGPGPAPAPAPPPAPDKKHARHFSLDVHPYILGTKKAKAEAVPAALPASRSQEGGFLSQAEDCGLGLAPAPIKDAPLPEKEIPYPTEPARAGLPSGGPFHVRSPPAAPAVAPLTPASLGKAEPLTILSRNATHPLLHINTLSSSPPSTSRERS

SEQ ID NO: 846125 - protein, 77 aa, Homo sapiens
MATALLAGEKLRELILPGAQDDKAGALAALLLQLKLELPFDRVVTIGTVLVPILLVTLVFTKNFAGWTLFSGSWDWL

SEQ ID NO: 846126 - protein, 138 aa, Homo sapiens
VEQMRKLRSEWQAGLGFPLLPPSGRETVTGMRSSGPSGAPHSGGSSPDTWLGVGPLLSSTLEEARPPPAPEPRSPPSHLPAALLESGSRVLGPLPTHVGHTCPARVAARDGPSSGRDTNLSLFSSPGWTLFSGSWDWL

SEQ ID NO: 846127 - protein, 165 aa, Homo sapiens
SPVSSAQPVRLPAPARVSSLPPEEPIYCYTPHNFTRDQALYARGYCWTELRDALPGVDASLWPSLFEHKFLPYALLAFAAIMYVPALGWEFLASTRLTSELNFLLQEIDNCYHRAAEGRAPKIEKQIQSKGPGITEREKREIIENAEKEKSPEQNLFEKYLERRG

SEQ ID NO: 846128 - protein, 633 aa, Homo sapiens
MATALLAGEKLRELILPGAQDDKAGALAALLLQLKLELPFDRVVTIGTVLVPILLVTLVFTKNFAEEPIYCYTPHNFTRDQALYARGYCWTELRDALPGVDASLWPSLFEHKFLPYALLAFAAIMYVPALGWEFLASTRLTSELNFLLQEIDNCYHRAAEGRAPKIEKQIQSKGPGITEREKREIIENAEKEKSPEQNLFEKYLERRGRSNFLAKLYLARHVLILLLSAVPISYLCTYYATQKQNEFTCALGASPDGAAGAGPAVRVSCKLPSVQLQRIIAGVDIVLLCVMNLIILVNLIHLFIFRKSNFIFDKLHKVGIKTRRQWRRSQFCDINILAMFCNENRDHIKSLNRLDFITNESDLMYDNVVRQLLAALAQSNHDATPTVRDSGVQTVDPSANPAEPDGAAEPPVVKRPRKKMKWIPTSNPLPQPFKEPLAIMRVENSKAEKPKPARRKTATDTLIAPLLDRSAHHYKGGGGDPGPGPAPAPAPPPAPDKKHARHFSLDVHPYILGTKKAKAEAVPAALPASRSQEGGFLSQAEDCGLGLAPAPIKDAPLPEKEIPYPTEPARAGLPSGGPFHVRSPPAAPAVAPLTPASLGKAEPLTILSRNATHPLLHINTLSSSPPSTSRERS

SEQ ID NO: 846129 - protein, 450 aa, Homo sapiens
MATALLAGEKLRELILPGAQDDKAGALAALLLQLKLELPFDRVVTIGTVLVPILLVTLVFTKNFAEEPIYCYTPHNFTRDQALYARGYCWTELRDALPGVDASLWPSLFEHKFLPYALLAFAAIMYVPALGWEFLASTRLTSELNFLLQEIDNCYHRAAEGRAPKIEKQIQSKGPGITEREKREIIENAEKEKSPEQNLFEKYLERRGRSNFLAKLYLARHVLILLLSAVPISYLCTYYATQKQNEFTCALGASPDGAAGAGPAVRVSCKLPSVQLQRIIAGVDIVLLCVMNLIILVNLIHLFIFRKSNFIFDKLHKVGIKTRRQWRRSQFCDINILAMFCNENRDHIKSLNRLDFITNESDLMYDNVVRQLLAALAQSNHDATPTVRDSGVQTVDPSANPAEPDGAAEPPVVKRPRKKMKWIPTSNPFPCSCIRCPAVGGGPEVKSLFF

SEQ ID NO: 846130 - protein, 81 aa, Homo sapiens
MATSRYEPVAEIGVGAYGTVYKARDPHSGHFVALKSVRVPNGGGGGGGLPISTVREVALLRRLEAFEHPNVVRLEGGGGLG

SEQ ID NO: 846131 - protein, 158 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTTWWNTSKAG

SEQ ID NO: 846132 - protein, 158 aa, Homo sapiens; identical to SEQ ID NO: 846131

SEQ ID NO: 846133 - protein, 158 aa, Homo sapiens; identical to SEQ ID NO: 846131

SEQ ID NO: 846134 - protein, 158 aa, Homo sapiens; identical to SEQ ID NO: 846131

SEQ ID NO: 846135 - protein, 158 aa, Homo sapiens; identical to SEQ ID NO: 846131

SEQ ID NO: 846136 - protein, 158 aa, Homo sapiens; identical to SEQ ID NO: 846131

SEQ ID NO: 846137 - protein, 158 aa, Homo sapiens; identical to SEQ ID NO: 846131

SEQ ID NO: 846138 - protein, 136 aa, Homo sapiens
ASSIGEEVEEAFPSVKPPHELCCWEGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTTWWNTSKAG

SEQ ID NO: 846139 - protein, 108 aa, Homo sapiens
MWTCWLYLCRECFVERPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 846140 - protein, 200 aa, Homo sapiens
MDVCATSRTDREIKVTLVFEHVDQDLRTYLDKAPPPGLPAETIKVSGVGGIERWIGTFVVEPSGISGMVPSFQCICTSPLKLGSDAPVSKRPRFPSCQLHRSPRSEAREHSGDNVVEHVKSWLTLGLARKSTSYQNGTLHPVGCYTLGTRGSRKFFCRSTYCNTCGTCGGVGCIFAENVSSKGLSSVETLKPTSWAKSLT

SEQ ID NO: 846141 - protein, 140 aa, Homo sapiens
MALYTPWVVTLWVPEAPESSSAGPHIATPVGHVEVLAVSLQRMFRRKRPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 846142 - protein, 158 aa, Homo sapiens; identical to SEQ ID NO: 846131

SEQ ID NO: 846143 - protein, 125 aa, Homo sapiens [sequence omitted]

SEQ ID NO: 846144 - protein, 170 aa, Homo sapiens
MATSRYEPVAEIGVGAYGTVYKARDPHSGHFVALKSVRVPNGGGGGGGLPISTVREVALLRRLEAFEHPNVVRRDETSVHTLPELTGEIKGNTMDAREQCSNHGTLEGRYLAQGTPPRKDCAQARTTESTGTLDWRPVYLHERLEFSFKWPNMHSAYTRRTLDRPSRTTP

SEQ ID NO: 846145 - protein, 98 aa, Homo sapiens
SQSKHLLSAPQRMGGGHVPRTSGVRPALPVSARLFGSWSHGEGGGEGASLACGLCLWSGPLRPAAPDRARVYGAVGTGSGAPITGRPHSTPGWREGLP

SEQ ID NO: 846146 - protein, 158 aa, Homo sapiens; identical to SEQ ID NO: 846131

SEQ ID NO: 846147 - protein, 158 aa, Homo sapiens; identical to SEQ ID NO: 846131

SEQ ID NO: 846148 - protein, 158 aa, Homo sapiens; identical to SEQ ID NO: 846131

SEQ ID NO: 846149 - protein, 158 aa, Homo sapiens; identical to SEQ ID NO: 846131

SEQ ID NO: 846150 - protein, 158 aa, Homo sapiens; identical to SEQ ID NO: 846131

SEQ ID NO: 846151 - protein, 158 aa, Homo sapiens; identical to SEQ ID NO: 846131

SEQ ID NO: 846152 - protein, 158 aa, Homo sapiens; identical to SEQ ID NO: 846131

SEQ ID NO: 846153 - protein, 108 aa, Homo sapiens; identical to SEQ ID NO: 846139

SEQ ID NO: 846154 - protein, 98 aa, Homo sapiens; identical to SEQ ID NO: 846145

SEQ ID NO: 846155 - protein, 158 aa, Homo sapiens; identical to SEQ ID NO: 846131

SEQ ID NO: 846156 - protein, 113 aa, Homo sapiens
SQSKHLLSAPQRMGGGHVPRTSGVRPALPVSARLFGSWSHGEGGGEGASLACGLCLWSGPLRPAAPDRARVYGAVGTGSGAPITGRPHSTPGWREGLSSVETLKPTSWAKSLT

SEQ ID NO: 846157 - protein, 192 aa, Homo sapiens
IYYAPVYILLYGLSNDIGYPHRVLICRIHLGDWSSYTPSVHVGRTRGRIYSYQMALTPWVVTLWVPEAPESSSAGPHIATPVGHVEVLAVSLQRMFRRKRPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 846158 - protein, 98 aa, Homo sapiens; identical to SEQ ID NO: 846145

SEQ ID NO: 846159 - protein, 1126 aa, Homo sapiens
EDCEHSGGRVAGVSGASGAGQQRAPGAAAASLPAPAEHIAAAEMGPPRHPQAGEIEAGGAGGGRRLQVEMSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPAVVATVSATRAQSPVITTTAAHATDSALSRPTLSIQHPPSAAISIQRPAQSRDVTTRITLPSHPALGTPKQQLHTMAQKTIFSTGTPVAAATVAPILATNTIPSATTAGSVSHTQAPTSTIVTMTVPSHSSHATAVTTSNIPVAKVVPQQITHTSPRIQPDYPAERSSLIPISGHRASPNPVAMETRSDNRPSVPVQFQYFLPTYPPSAYPLAAHTYTPITSSVSTIRQYPVSAQAPNSAITAQTGVGVASTVHLNPMQLMTVDASHARHIQGIQPAPISTQGIQPAPIGTPGIQPAPLGTQGIHSATPINTQGLQPAPMGTQQPQPEGKTSAVVLADGATIVANPISNPFSAAPAATTVVQTHSQSASTNAPAQGSSPRPSILRKKPATDGMAVRKTLIPPQPPDVASPRVESSMRSTSGSPRPAGAKPKSEIHVSMATPVTVSMETVSNQNNDQPTIAVPPTAQQPPPTIPTMIAAASPPSQPAVALSTIPGAVPITPPITTIAAAPPPSVTVGGSLSSVLGPPVPEIKVKEEVEPMDIMRPVSAVPPLATNTVSPSLALLANNLSMPTSDLPPGASPRKKPRKQQHVISTEEGDMMETNSTDDEKSTAKSLLVKAEKRKSPPKEYIDEEGVRYVPVRPRPPITLLRHYRNPWKAAYHHFQRYSDVRVKEEKKAMLQEIANQKGVSCRAQGWKVHLCAAQLLQLTNLEHDVYERLTNLQEGIIPKKKAATDDDLHRINELIQGNMQRCKLVMDQISEARDSMLKVLDHKDRVLKLLNKNGTVKKVSKLKRKEKV

SEQ ID NO: 846160 - protein, 152 aa, Homo sapiens
MAFTLLEHKSFTFLNTEIHVFLFFMVPEEKKAMLQEIANQKGVSCRAQGWKVHLCAAQLLQLTNLEHDVYERLTNLQEGIIPKKKAATDDDLHRINELIQGNMQRCKLVMDQISEARDSMLKVLDHKDRVLKLLNKNGTVKKVSKLKRKEKV

SEQ ID NO: 846161 - protein, 1126 aa, Homo sapiens; identical to SEQ ID NO: 846159

SEQ ID NO: 846162 - protein, 1091 aa, Homo sapiens
EDCEHSGGRVAGVSGASGAGQQRAPGAAAASLPAPAEHIAAAEMGPPRHPQAGEIEAGGAGGGRRLQVEMSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPAVVATVSATRAQSPVITTTAAHATDSALSRPTLSIQHPPSAAISIQRPAQSRDVTTRITLPSHPALGTPKQQLHTMAQKTIFSTGTPVAAATVAPILATNTIPSATTAGSVSHTQAPTSTIVTMTVPSHSSHATAVTTSNIPVAKVVPQQITHTSPRIQPDYPAERSSLIPISGHRASPNPVAMETRSDNRPSVPVQFQYFLPTYPPSAYPLAAHTYTPITSSVSTIRQYPVSAQAPNSAITAQTGVGVASTVHLNPMQLMTVDASHARHIQGIQPAPISTQGIQPAPIGTPGIQPAPLGTQGIHSATPINTQGLQPAPMGTQQPQPEGKTSAVVLADGATIVANPISNPFSAAPAATTVVQTHSQSASTNAPAQGSSPRPSILRKKPATDGAKPKSEIHVSMATPVTVSMETVSNQNNDQPTIAVPPTAQQPPPTIPTMIAAASPPSQPAVALSTIPGAVPITPPITTIAAAPPPSVTVGGSLSSVLGPPVPEIKVKEEVEPMDIMRPVSAVPPLATNTVSPSLALLANNLSMPTSDLPPGASPRKKPRKQQHVISTEEGDMMETNSTDDEKSTAKSLLVKAEKRKSPPKEYIDEEGVRYVPVRPRPPITLLRHYRNPWKAAYHHFQRYSDVRVKEEKKAMLQEIANQKGVSCRAQGWKVHLCAAQLLQLTNLEHDVYERLTNLQEGIIPKKKAATDDDLHRINELIQGNMQRCKLVMDQISEARDSMLKVLDHKDRVLKLLNKNGTVKKVSKLKRKEKV

SEQ ID NO: 846163 - protein, 147 aa, Homo sapiens
GSPHCRLIPETLPPLQGQCVRAKEKKAMLQEIANQKGVSCRAQGWKVHLCAAQLLQLTNLEHDVYERLTNLQEGIIPKKKAATDDDLHRINELIQGNMQRCKLVMDQISEARDSMLKVLDHKDRVLKLLNKNGTVKKVSKLKRKEKV

SEQ ID NO: 846164 - protein, 109 aa, Homo sapiens
MADGNEDLRADDLPGPAFESYESMELACPAERSGHVAVSDGRHMFVWGGYKVSEWPGRDGRRSAVTRVCVRGQAGRPERAAEGAPRLRRAPHLRLCPLVVFFLRAGIFL

SEQ ID NO: 846165 - protein, 249 aa, Homo sapiens
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRVSIQTTSMTCF

SEQ ID NO: 846166 - protein, 249 aa, Homo sapiens; identical to SEQ ID NO: 846165

SEQ ID NO: 846167 - protein, 249 aa, Homo sapiens; identical to SEQ ID NO: 846165

SEQ ID NO: 846168 - protein, 334 aa, Homo sapiens
METGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRLSLEAVICFKEMLANSWNCLPKHLLHSVNQRFGSNNTSGS

SEQ ID NO: 846169 - protein, 364 aa, Homo sapiens
MFTPLGRLQSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRLSLEAVICFKEMLANSWNCLPKHLLHSVNQRFGSNNTSGS

SEQ ID NO: 846170 - protein, 406 aa, Homo sapiens
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRLSLEAVICFKEMLANSWNCLPKHLLHSVNQRFGSNNTSGS

SEQ ID NO: 846171 - protein, 406 aa, Homo sapiens; identical to SEQ ID NO: 846170

SEQ ID NO: 846172 - protein, 366 aa, Homo sapiens
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVR

SEQ ID NO: 846173 - protein, 368 aa, Homo sapiens
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRYI

SEQ ID NO: 846174 - protein, 385 aa, Homo sapiens
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRHCKKKHGENKKILRLEEKP

SEQ ID NO: 846175 - protein, 157 aa, Homo sapiens [sequence omitted]

SEQ ID NO: 846176 - protein, 406 aa, Homo sapiens; identical to SEQ ID NO: 846170

SEQ ID NO: 846177 - protein, 122 aa, Homo sapiens
SSRPPYVVWGGYKSLMSNQVRGLYDFYLPREELWIYNMETGRWKKINTEGDVPPSMSGSCAVCVDRVLYLFGGHHSRGNTNKVSVSKDYGLRHFYSYYLSNNCKFLRLAPDLFVSQLKMMCT

SEQ ID NO: 846178 - protein, 249 aa, Homo sapiens; identical to SEQ ID NO: 846165

SEQ ID NO: 846179 - protein, 406 aa, Homo sapiens; identical to SEQ ID NO: 846170

SEQ ID NO: 846180 - protein, 386 aa, Homo sapiens
MKLVSQDRFKKYSSASLKYQFLYLQFFLFLESNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRLSLEAVICFKEMLANSWNCLPKHLLHSVNQRFGSNNTSGS

SEQ ID NO: 846181 - protein, 334 aa, Homo sapiens; identical to SEQ ID NO: 846168

SEQ ID NO: 846182 - protein, 249 aa, Homo sapiens; identical to SEQ ID NO: 846165

SEQ ID NO: 846183 - protein, 357 aa, Homo sapiens [sequence omitted]

SEQ ID NO: 846184 - protein, 369 aa, Homo sapiens
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRQGT

SEQ ID NO: 846185 - protein, 72 aa, Homo sapiens
LPCVPTGAPLAFNLTTLSRQSLLLPPCGPLSATLCCRREKQVPGLTLNDLFPPRSLNTGSEEELEELCEQAV

SEQ ID NO: 846186 - protein, 783 aa, Homo sapiens [sequence omitted]

SEQ ID NO: 846187 - protein, 229 aa, Homo sapiens
MSGGHQLQLAALWPWLLMATLQAGFGRTGLVLAAAVESERSAEQKAVIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDYDVWILMTVVGTIFVIILASVLRIRSSSRGSSA

SEQ ID NO: 846188 - protein, 783 aa, Homo sapiens [sequence omitted]

SEQ ID NO: 846189 - protein, 783 aa, Homo sapiens [sequence omitted]

SEQ ID NO: 846190 - protein, 869 aa, Homo sapiens
MSGGHQLQLAALWPWLLMATLQAGFGRTGLVLAAAVESERSAEQKAVIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGEFSEGSGCGRERRLQLNISGQVKSANKGLMEAEKDTAEMTTKILNHRDSVSCWLECRNTPPLPGATPLVGRSQGGPREVLVWLRHQKGTWKAGCDGSCL

SEQ ID NO: 846191 - protein, 206 aa, Homo sapiens
MSGGHQLQLAALWPWLLMATLQAGFGRTGLVLAAAVESERSAEQKAVIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWVSTLDLQTLPCT

SEQ ID NO: 846192 - protein, 75 aa, Homo sapiens
VLLRPPSAAPEERGDSTSLTACTVTKKTMRPPGPEICVIVGKRRKTNKGTVNGVTWLEYGSNYKACSALARRQPT

SEQ ID NO: 846193 - protein, 106 aa, Homo sapiens
VLLRPPSAAPEERGDSTSLTACTVTKKTMRPPGPEICVIVGKRRKTNKGTVNGVTWLEYGSNYKACSALARRCSLALSPRLECNGTILAHCNLCLPGSSDSSASAS

SEQ ID NO: 846194 - protein, 110 aa, Homo sapiens
VLLRPPSAAPEERGDSTSLTACTVTKKTMRPPGPEICVIVGKRRKTNKGTVNGVTWLEYGSNYKACSALARRKGYMKTEQEGSYLQARKRVLTKTQPCWYPDLQLPVLSC

SEQ ID NO: 846195 - protein, 72 aa, Homo sapiens
VLLRPPSAAPEERGDSTSLTACTVTKKTMRPPGPEICVIVGKRRKTNKGTVNGVTWLEYGSNYKACSALARR

SEQ ID NO: 846196 - protein, 95 aa, Homo sapiens
AAAVKRGGRRGHRGRAGAAAAAAMGALTSRQHAGVEEVDIPSNSVYRYPPKSGSYFASHFIMGGEKFDSTHPEGYLFGENSDLNFLGNRPVVVWL

SEQ ID NO: 846197 - protein, 658 aa, Homo sapiens
CNPGTRKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGLPAESPDSNFAGLPAGEQDAEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 846198 - protein, 440 aa, Homo sapiens
AAAVKRGGRRGHRGRAGAAAAAAMGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSLLKIQKISWAWLQAPVVPATWEAEAGEWPEPGRRSLQ

SEQ ID NO: 846199 - protein, 461 aa, Homo sapiens
MTKSNVNADFVRNYYLSELFSHAALSVKYGTGRALCHWLHFFLLGQVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGLPAESPDSNFAGLPAGEQDAEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 846200 - protein, 260 aa, Homo sapiens
AAAVKRGGRRGHRGRAGAAAAAAMGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQ

SEQ ID NO: 846201 - protein, 588 aa, Homo sapiens
MLSLWFSRCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGLPAESPDSNFAGLPAGEQDAEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 846202 - protein, 702 aa, Homo sapiens
AAAVKRGGRRGHRGRAGAAAAAAMGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGLPAESPDSNFAGLPAGEQDAEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 846203 - protein, 458 aa, Homo sapiens
SRVSRGSRQALASPQTETVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGLPAESPDSNFAGLPAGEQDAEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 846204 - protein, 702 aa, Homo sapiens; identical to SEQ ID NO: 846202

SEQ ID NO: 846205 - protein, 436 aa, Homo sapiens
AAAVKRGGRRGHRGRAGAAAAAAMGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTI

SEQ ID NO: 846206 - protein, 266 aa, Homo sapiens
AAAVKRGGRRGHRGRAGAAAAAAMGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVSI

SEQ ID NO: 846207 - protein, 433 aa, Homo sapiens
CGPRTRREPSSGEEAAPVTAMAAESALQVVEKLQARLAANPDPKKLLKYLKKLSTLPITVDILAETGVGKTVNSLRKHEHVGSFARDLVAQWKKLVPVERNAEPDEQDFEKSNSRKRPRDALQKEEEMEGDYQETWKATGSRSYSPDHRQKKHRKLSELERPHKVSHGHERRDERKRCHRMSPTYSSDPESSDYGHVQSPPSCTSPHQMYVDHYRSLEEDQEPIVSHQKPGKGHSNAFQDRLGASQERHLGEPHGKGVVSQNKEHKSSHKDKRPVDAKSDEKASVVSREKSHKALSKEENRRPPSGDNAREKPPSSGVKKEKDREGSSLKKKCLPPSEAASDNHLKKPKHRDPEKAKLDKSKQGLDSFDTGKGAGDLLPKVKEKGSNNLKTPEGKVKTNLDRKSLGSLPKVEETDMEDEFEQPTMSFEILPQL

SEQ ID NO: 846208 - protein, 433 aa, Homo sapiens; identical to SEQ ID NO: 846207

SEQ ID NO: 846209 - protein, 375 aa, Homo sapiens
MNSSSQPCLLKSYLSYDQPRKKKKKIVKTSATALGDKGLKKNDSKSTGKNLDSVQKLPKVNKTKSEKPAGADLAKLRKVPDVLPVLPDLPLPAIQANYRPLPSLELISSFQPKRKAFSSPQEEEEAGFTGRRMNSKMQVYSGSKCAYLPKMMTLHQQCIRVLKNNIDSIFEVGGVPYSVLEPVLERCTPDQLYRIEEYNHVLIEETDQLWKVHCHRDFKEERPEEYESWREMYLRLQDAREQRLRVLTKNIQFAHANKPKGRQAKMAFVNSVAKPPRDVRRRQEKFGTGGAAVPEKIKIKPAPYPMGSSHASASSISFNPSPEEPAYDGPSTSSAHLAPVVSSTVSYDPRKPTVKKIAPMMAKTIKAFKNRFSRR

SEQ ID NO: 846210 - protein, 433 aa, Homo sapiens; identical to SEQ ID NO: 846207

SEQ ID NO: 846211 - protein, 125 aa, Homo sapiens
PSLKLRRQIWRMNSSSQPCLLKSYLSYDQPRKKKKKIVKTSATALGDKGLKKNDSKSTGKNLDSVQKLPKVNKTKSEKPAGADLAKLRKVTPSAPWWLPTQSTWPCRAQRIALPLFSLACFWGAC

SEQ ID NO: 846212 - protein, 375 aa, Homo sapiens; identical to SEQ ID NO: 846209

SEQ ID NO: 846213 - protein, 105 aa, Homo sapiens
MISSITSPGDQAQDLVEGVAFTLVVHLRARWPGGTSLCGGGHSWNSLLGPPQFDVISPGIGPPRTRLTFMLLQRARHRATLFSRFLLKTPCEPMIINCPNDGQDN

SEQ ID NO: 846214 - protein, 73 aa, Homo sapiens
LEVPQQNKLGYFPPMSNELSLKDSTPQWEPLDPMLEFPLCKNLHFSTINFDQVAMSGTKLSDNCLYTVSKSSV

SEQ ID NO: 846215 - protein, 112 aa, Homo sapiens
MGSTEILEKETPENLSNGTSSNVEAAKRLAKRLYQLDRFKRSDVAKHLGKNNEFSKLVAEEYLKFFDFTGMTLDQSLRVSLCHPGWSAVAPSWLTATSTSQVQAVLLNQPPE

SEQ ID NO: 846216 - protein, 551 aa, Homo sapiens
MGSSWCLYGCCNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHLVVAFAAVAKIKAQDLLRQEGRGAAKTAGQPEGRPVPDNIGKKMTCQEFIANLQGVNEGVDFSKDLLKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 846217 - protein, 191 aa, Homo sapiens
RPRRRRTSGGLLEPGGGRGDHVREALPPLHHRPRHQSNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHVSVDL

SEQ ID NO: 846218 - protein, 112 aa, Homo sapiens; identical to SEQ ID NO: 846215

SEQ ID NO: 846219 - protein, 163 aa, Homo sapiens
MGSSWCLYGCCNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHNDQ

SEQ ID NO: 846220 - protein, 551 aa, Homo sapiens; identical to SEQ ID NO: 846216

SEQ ID NO: 846221 - protein, 173 aa, Homo sapiens
MGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHNIGKKMTCQEFIANLQGVNEGVDFSKDLLKVLWDWRRC

SEQ ID NO: 846222 - protein, 534 aa, Homo sapiens
MGYSSGVTNGLNDASDSIYTKGTPEIAFWGSNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHVNIGKKMTCQEFIANLQGVNEGVDFSKDLLKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 846223 - protein, 1204 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 846224 - protein, 1262 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 846225 - protein, 121 aa, Homo sapiens
SCDVYLGLSENYEMKVASHFMKPLAVGLLESDFDTCIERYVITNPPYEFELVPTDLIFCLMQFDHNAGQSRASLSHSSHSSQSSSKKSSSVHSIPSTANRQNRPKSRESRDKQKYVQEERL

SEQ ID NO: 846226 - protein, 936 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPVSPRSHY

SEQ ID NO: 846227 - protein, 733 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKTDANVHFPTLTTTPVD

SEQ ID NO: 846228 - protein, 722 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRPPQLCLPLAAQKRCFQSDKLDIFI

SEQ ID NO: 846229 - protein, 678 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAKTEQLVFFQNCKNFFGGGSE

SEQ ID NO: 846230 - protein, 113 aa, Homo sapiens
DTKKSCNLDVGCHDFRVFAYRTFPSLSLLPQTYFNDNILTLIRTLVTGGATPELEALIAEENALRGGYSTPQTLANRDRCRVAQLALLDGPFADLGVSPQHRGHLSLLFGKSL

SEQ ID NO: 846231 - protein, 1204 aa, Homo sapiens; identical to SEQ ID NO: 846223

SEQ ID NO: 846232 - protein, 1233 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 846233 - protein, 1261 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 846234 - protein, 741 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRRQWPVLRILILTASTTRQ

SEQ ID NO: 846235 - protein, 624 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKVSSLIQAALILHGWN

SEQ ID NO: 846236 - protein, 610 aa, Homo sapiens
IPGCLGWRWRREELPRSPCTGCPLLAMANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKL

SEQ ID NO: 846237 - protein, 111 aa, Homo sapiens
MTREPPGCRRVNSLMLYTLRSITSHRSSHPERWATSSQFLPYIPVQPQPLELSFYTMDLITVHLLYGCPSLLHGPTLAGTVLGAAGDPRPWPVHASQPPYTGHPYVLPFRA

SEQ ID NO: 846238 - protein, 380 aa, Homo sapiens
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 846239 - protein, 364 aa, Homo sapiens
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFSLTHLEREPPGRRILADGRNC

SEQ ID NO: 846240 - protein, 329 aa, Homo sapiens
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 846241 - protein, 380 aa, Homo sapiens; identical to SEQ ID NO: 846238

SEQ ID NO: 846242 - protein, 190 aa, Homo sapiens
MRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 846243 - protein, 163 aa, Homo sapiens
SESRSDIVMHAWNVAAIVQSIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 846244 - protein, 188 aa, Homo sapiens
KVKLYKQQCLKTDGHVTFITCPERVAEVPGVLKLPVHRSRRYTVSSGALSVVTGALAEQDSTVMSQMRFGRPLRRRGFIGSLRYLCRPSRLAVILEQVSVGSHERWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 846245 - protein, 90 aa, Homo sapiens
MGIQGLAKLIADVAPSAIRENDIKSYFGRKVAIDASMSIYQFLIAVRQGGDVLQNEEGETTSHLMGMFYRTIRMMENGIKPVYVFDGKPP

SEQ ID NO: 846246 - protein, 380 aa, Homo sapiens; identical to SEQ ID NO: 846238

SEQ ID NO: 846247 - protein, 69 aa, Homo sapiens
SPAISGVEGAGACGDLVWVEWGQAVEKGTPGSLRDSVLPGGTGCHESSRLRGRSLHYAPQEAVRGEQVT

SEQ ID NO: 846248 - protein, 270 aa, Homo sapiens
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCEDLTPTSTLCQKIGSTRRLTSSSWNLRCWTQSLWS

SEQ ID NO: 846249 - protein, 380 aa, Homo sapiens; identical to SEQ ID NO: 846238

SEQ ID NO: 846250 - protein, 316 aa, Homo sapiens
MGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 846251 - protein, 233 aa, Homo sapiens [sequence omitted]

SEQ ID NO: 846252 - protein, 149 aa, Homo sapiens
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDDQGDRLTLFS

SEQ ID NO: 846253 - protein, 169 aa, Homo sapiens
MLPSTMFLVHLPLSTNRLHCLRNTSLESYLCSFVHLNHPLHISDRVILISLHEAVRFSFAFSFPRGTLSIAYCLMSSVSTSSEAIMSTELLANYCHSSLHVCICISSFPNETGNHDSFPGAVVSISDQPTDQCKLAAKELPLRNLLECRFFDCMGEEDLINLGVIGTER

SEQ ID NO: 846254 - protein, 296 aa, Homo sapiens
MDGDGDPESVGQPEEASPEEQPEEASAEEERPEDQQEEEAAAAAAYLDELPEPLLLRVLAALPAAELVQACRLVCLRWKELVDGAPLWLLKCQQEGLVPEGGVEEERDHWQQFYFLSKRRRNLLRNPCGEEDLEGWCDVEHGGDGWRVEELPGDSGVEFTHDESVKKYFASSFEWCRKAQVIDLQAEGYWEELLDTTQPAIVVKDWYSGRSDAGCLYELTVKLLSEHENVLAEFSSGQVAVPQDSDGGGWMEISHTFTDYGPGVRFVRFEHGGQDSVYWKGWFGARVTNSSVWVEP

SEQ ID NO: 846255 - protein, 296 aa, Homo sapiens; identical to SEQ ID NO: 846254

SEQ ID NO: 846256 - protein, 313 aa, Homo sapiens
MDALPPGVTGAVQGAWDTSGTLIKESVGQPEEASPEEQPEEASAEEERPEDQQEEEAAAAAAYLDELPEPLLLRVLAALPAAELVQACRLVCLRWKELVDGAPLWLLKCQQEGLVPEGGVEEERDHWQQFYFLSKRRRNLLRNPCGEEDLEGWCDVEHGGDGWRVEELPGDSGVEFTHDESVKKYFASSFEWCRKAQVIDLQAEGYWEELLDTTQPAIVVKDWYSGRSDAGCLYELTVKLLSEHENVLAEFSSGQVAVPQDSDGGGWMEISHTFTDYGPGVRFVRFEHGGQDSVYWKGWFGARVTNSSVWVEP

SEQ ID NO: 846257 - protein, 289 aa, Homo sapiens
MDGDGDPESVGQPEEASPEEQPEEASAEEERPEDQQEEEAAAAAAYLDELPEPLLLRVLAALPAAELVQACRLVCLRWKELVDGAPLWLLKCQQEGLVPEGGVEEERDHWQQFYFLSKRRRNLLRNPCGEEDLEGWCDVEHGGDGWRVEELPGDSGVEFTHDESVKKWCRKAQVIDLQAEGYWEELLDTTQPAIVVKDWYSGRSDAGCLYELTVKLLSEHENVLAEFSSGQVAVPQDSDGGGWMEISHTFTDYGPGVRFVRFEHGGQDSVYWKGWFGARVTNSSVWVEP

SEQ ID NO: 846258 - protein, 206 aa, Homo sapiens
MDGDGDPESVGQPEEASPEEQPEEASAEEERPEDQQEEEAAAAAAYLDELPEPLLLRVLAALPAAELVQACRLVCLRWKELVDGAPLWLLKCQQEGLVPEGGVEEERDHWQQFYFLSKRRRNLLRNPCGEEDLEGWCDVEHGGDGWRVEELPGDSGVEFTHDESVKKYFASSFEWCRKAQVIDLQAEGYWEELLDTTQPAIVVKDW

SEQ ID NO: 846259 - protein, 298 aa, Homo sapiens
MPWTLGPTPESVGQPEEASPEEQPEEASAEEERPEDQQEEEAAAAAAYLDELPEPLLLRVLAALPAAELVQACRLVCLRWKELVDGAPLWLLKCQQEGLVPEGGVEEERDHWQQFYFLSKRRRNLLRNPCGEEDLEGWCDVEHGGDGWRVEELPGDSGVEFTHDESVKKYFASSFEWCRKAQVIDLQAEGYWEELLDTTQPAIVVKDWYSGRSDAGCLYELTVKLLSEHENVLAEFSSGQVAVPQDSDGGGWMEISHTFTDYGPGVRFVRFEHGGQDSVYWKGWFGARVTNSSVWVEP

SEQ ID NO: 846260 - protein, 272 aa, Homo sapiens
MDGDGDPESVGQPEEASPEEQPEEASAEEERPEDQQEEEAAAAAAYLDELPEPLLLRVLAALPAAELVQACRLVCLRWKELVDGAPLWLLKCQQEGLVPEGGVEEERDHWQQFYFLSKRRRNLLRNPCGEEDLEGWCDVEHGGDGWRVEELPGDSGVEFTHDESVKKYFASSFEWCRKAQVIDLQAEGYWEELLDTTQPAIVVKDWYSGRSDAGCLYELTVKLLSEHENVLAEFSSGQVAVPQDSDGGGWMERPHLPQATHPPPIPCSDPSP

SEQ ID NO: 846261 - protein, 222 aa, Homo sapiens
MILLLLLVDGAPLWLLKCQQEGLVPEGGVEEERDHWQQFYFLSKRRRNLLRNPCGEEDLEGWCDVEHGGDGWRVEELPGDSGVEFTHDESVKKYFASSFEWCRKAQVIDLQAEGYWEELLDTTQPAIVVKDWYSGRSDAGCLYELTVKLLSEHENVLAEFSSGQVAVPQDSDGGGWMEISHTFTDYGPGVRFVRFEHGGQDSVYWKGWFGARVTNSSVWVEP

SEQ ID NO: 846262 - protein, 523 aa, Homo sapiens
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 846263 - protein, 536 aa, Homo sapiens
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILRLDKEGNGYKILNFIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 846264 - protein, 523 aa, Homo sapiens; identical to SEQ ID NO: 846262

SEQ ID NO: 846265 - protein, 523 aa, Homo sapiens; identical to SEQ ID NO: 846262

SEQ ID NO: 846266 - protein, 523 aa, Homo sapiens; identical to SEQ ID NO: 846262

SEQ ID NO: 846267 - protein, 523 aa, Homo sapiens; identical to SEQ ID NO: 846262

SEQ ID NO: 846268 - protein, 570 aa, Homo sapiens
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRWNLALSPKLECSGEISGHCNLYLLGSSDSPASASRVAGTTGARHHTQLIFVFLVETGFHHVGQDGLDLLNS

SEQ ID NO: 846269 - protein, 254 aa, Homo sapiens
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVVGLL

SEQ ID NO: 846270 - protein, 248 aa, Homo sapiens
MDSSGWRGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVVGLL

SEQ ID NO: 846271 - protein, 523 aa, Homo sapiens; identical to SEQ ID NO: 846262

SEQ ID NO: 846272 - protein, 517 aa, Homo sapiens
MDSSGWRGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 846273 - protein, 523 aa, Homo sapiens; identical to SEQ ID NO: 846262

SEQ ID NO: 846274 - protein, 523 aa, Homo sapiens; identical to SEQ ID NO: 846262

SEQ ID NO: 846275 - protein, 525 aa, Homo sapiens
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQSLLMELYSGETIFGKFWRKNGSGPNLK

SEQ ID NO: 846276 - protein, 320 aa, Homo sapiens
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILRLDKEGNGYKILNL

SEQ ID NO: 846277 - protein, 679 aa, Homo sapiens
MCRGCGCLPPDAPCPTLCSRNPAMVNEARGNSSLNPCLEGSASSGSESSKDSSRCSTPGLDPERHERLREKMRRRLESGDKWFSLEFFPPRTAEGAVNLISRFDRMAAGGPLYIDVTWHPAGDPGSDKETSSMMIASTAVNYCGLETILHMTCCRQRLEEITGHLHKAKQLGLKNIMALRGDPIGDQWEEEEGGFNYAVDLVKHIRSEFGDYFDICVAGYPKGHPEAGSFEADLKHLKEKVSAGADFIITQLFFEADTFFRFVKACTDMGITCPIVPGIFPIQGYHSLRQLVKLSKLEVPQEIKDVIEPIKDNDAAIRNYGIELAVSLCQELLASGLVPGLHFYTLNREMATTEVLKRLGMWTEDPRRPLPWALSAHPKRREEDVRPIFWASRPKSYIYRTQEWDEFPNGRWGNSSSPAFGELKDYYLFYLKSKSPKEELLKMWGEELTSEASVFEVFVLYLSGEPNRNGHKVTCLPWNDEPLAAETSLLKEELLRVNRQGILTINSQPNINGKPSSDPIVGWGPSGGYVFQKAYLEFFTSRETAEALLQVLKKYELRVNYHLVNVKGENITNAPELQPNAVTWGIFPGREIIQPTVVDPVSFMFWKDEAFALWIERWGKLYEEESPSRTIIQYIHDNYFLVNLVDNDFPLDNCLWQVVEDTLELLNRPTQNARETEAP

SEQ ID NO: 846278 - protein, 679 aa, Homo sapiens; identical to SEQ ID NO: 846277

SEQ ID NO: 846279 - protein, 692 aa, Homo sapiens
PAPRPFTAFPAPAAATVVRPAAERSESPGTGGRNPAMVNEARGNSSLNPCLEGSASSGSESSKDSSRCSTPGLDPERHERLREKMRRRLESGDKWFSLEFFPPRTAEGAVNLISRFDRMAAGGPLYIDVTWHPAGDPGSDKETSSMMIASTAVNYCGLETILHMTCCRQRLEEITGHLHKAKQLGLKNIMALRGDPIGDQWEEEEGGFNYAVDLVKHIRSEFGDYFDICVAGYPKGHPEAGSFEADLKHLKEKVSAGADFIITQLFFEADTFFRFVKACTDMGITCPIVPGIFPIQGYHSLRQLVKLSKLEVPQEIKDVIEPIKDNDAAIRNYGIELAVSLCQELLASGLVPGLHFYTLNREMATTEVLKRLGMWTEDPRRPLPWALSAHPKRREEDVRPIFWASRPKSYIYRTQEWDEFPNGRWGNSSSPAFGELKDYYLFYLKSKSPKEELLKMWGEELTSEASVFEVFVLYLSGEPNRNGHKVTCLPWNDEPLAAETSLLKEELLRVNRQGILTINSQPNINGKPSSDPIVGWGPSGGYVFQKAYLEFFTSRETAEALLQVLKKYELRVNYHLVNVKGENITNAPELQPNAVTWGIFPGREIIQPTVVDPVSFMFWKDEAFALWIERWGKLYEEESPSRTIIQYIHDNYFLVNLVDNDFPLDNCLWQVVEDTLELLNRPTQNARETEAP

SEQ ID NO: 846280 - protein, 672 aa, Homo sapiens
PAPRPFTAFPAPAAATVVRPAAERSESPGTGGRNPAMVNEARGNSSLNPCLEGSASSGSESSKDSSRCSTPGLDPERHERLREKMRRRLESGDKWFSLEFFPPRTAEGAVNLISRFDRMAAGGPLYIDVTWHPAGDPGSDKETSSMMIASTAVNYCGLETILHMTCCRQRLEEITGHLHKAKQLGLKNIMALRGDPIGDQWEEEEGGFNYAVDLVKHIRSEFGDYFDICVAGYPKGHPEAGSFEADLKHLKEKVSAGADFIITQLFFEADTFFRFVKACTDMGITCPIVPGIFPIQGYHSLRQLVKLSKLEVPQEIKDVIEPIKDNDAAIRNYGIELAVSLCQELLASGLVPGLHFYTLNREMATTEVLKRLGMWTEDPRRPLPWALSAHPKRREEDVRPIFWASRPKSYIYRTQEWDEFPNGLLSKSPKEELLKMWGEELTSEASVFEVFVLYLSGEPNRNGHKVTCLPWNDEPLAAETSLLKEELLRVNRQGILTINSQPNINGKPSSDPIVGWGPSGGYVFQKAYLEFFTSRETAEALLQVLKKYELRVNYHLVNVKGENITNAPELQPNAVTWGIFPGREIIQPTVVDPVSFMFWKDEAFALWIERWGKLYEEESPSRTIIQYIHDNYFLVNLVDNDFPLDNCLWQVVEDTLELLNRPTQNARETEAP

SEQ ID NO: 846281 - protein, 79 aa, Homo sapiens
VSFMFWKVKEPGASLPRPPGKPWGGIGTKSQACTEGHTGPSLQGTPSSDSPMSLLTQGVYFWAGVGSDTGSGPCSIPGN

SEQ ID NO: 846282 - protein, 66 aa, Homo sapiens
MTSTNPADPIGDQWEEEEGGFNYAVDLVKHIRSEFGDYFDICVAGEWLDHPGGGDGAREAEMPREP

SEQ ID NO: 846283 - protein, 129 aa, Homo sapiens
CGAVTSPSCALPSMLWTWQREKGKLGDLHLEGLREAKTGWVFVGGRERDSGCQTCWSPQPAHRLSQVTCLPWNDEPLAAETSLLKEELLRVNRQGILTINSQPNINGKPSSDPIVGWGPSGGYVFQKVW

SEQ ID NO: 846284 - protein, 106 aa, Homo sapiens
MAQASPSALAPIPRTHQTAHTAPLTVASVYGPCFGLCRLWAQGWSALLVPGPSSTGAGLGPSYSVQATVARAGRQGRGNVPCTLERGVESQEVKVGPGRQLLLVPA

SEQ ID NO: 846285 - protein, 679 aa, Homo sapiens; identical to SEQ ID NO: 846277

SEQ ID NO: 846286 - protein, 215 aa, Homo sapiens
PAPRPFTAFPAPAAATVVRPAAERSESPGTGGRNPAMVNEARGNSSLNPCLEGSASSGSESSKDSSRCSTPGLDPERHERLREKMRRRLESGDKWFSLEFFPPRTAEGAVNLISRFDRMAAGGPLYIDVTWHPAGDPGSDKETSSMMIASTAVNYCGLETILHMTCCRQRLEEITGHLHKAKQLGLKNIMALRGGVEPALPYTLGSGFPGGHLVA

SEQ ID NO: 846287 - protein, 93 aa, Homo sapiens
EESGAEFTGMASWACGGTALCQECALTSGHPSARGNSSSPAFGELKDYYLFYLKSKSPKEELLKMWGEELTSEASVFEVFVLYLSGEPNRNGH

SEQ ID NO: 846288 - protein, 82 aa, Homo sapiens
SSPDTLGVCERASGRAGVGDRHLSLPQAYLEFFTSRETAEALLQVLKKYELRVNYHLVNVKVGQAPGFPQSTRPFVEQTPST

SEQ ID NO: 846289 - protein, 292 aa, Homo sapiens
MTTARYRPTWDLALDPLVSCKLCLGEYPVEQMTTIAQCQCIFCTLCLKQYVELLIKEGLETAISCPDAACPKQGHLQENEIECMVAAEIMQRYKKLQFEREVLFDPCRTWCPASTCQAVCQLQDVGLQTPQPVQCKACRMEFCSTCKASWHPGQGCPETMPITFLPGETSAAFKMEEDDAPIKRCPKCKVYIERDEGCAQMMCKNCKHAFCWYCLESLDDDFLLIHYDKGPCRNKLGHSRASVIWHRTQVVGIFAGFGLLLLVASPFLLLATPFVLCCKCKCSKGDDDPLPT

SEQ ID NO: 846290 - protein, 90 aa, Homo sapiens
GLALQCGPCGLRGRGEARAANCGHPAPRSQYRAEASEPRTADEQAQASSTLLTLTCPQPPPALQGALVPETFSHFSLWVPDLRAETSECV

SEQ ID NO: 846291 - protein, 82 aa, Homo sapiens
AGIAVRAVRAARARGGAGGKLRAPGTPQPVPGGGVRAAHRGRAGPGRVTRVPFVSASPGPAAERGGRDAALRGRPWGSGLAA

SEQ ID NO: 846292 - protein, 292 aa, Homo sapiens; identical to SEQ ID NO: 846289

SEQ ID NO: 846293 - protein, 258 aa, Homo sapiens [sequence omitted]

SEQ ID NO: 846294 - protein, 90 aa, Homo sapiens; identical to SEQ ID NO: 846290

SEQ ID NO: 846295 - protein, 209 aa, Homo sapiens
MVAAEIMQRYKKLQFEREVLFDPCRTWCPASTCQAVCQLQDVGLQTPQPVQCKACRMEFCSTCKASWHPGQGCPETMPITFLPGETSAAFKMEEDDAPIKRCPKCKVYIERDEGCAQMMCKNCKHAFCWYCLESLDDDFLLIHYDKGPCRNKLGHSRASVIWHRTQVVGIFAGFGLLLLVASPFLLLATPFVLCCKCKCSKGDDDPLPT

SEQ ID NO: 846296 - protein, 258 aa, Homo sapiens [sequence omitted]

SEQ ID NO: 846297 - protein, 292 aa, Homo sapiens; identical to SEQ ID NO: 846289

SEQ ID NO: 846298 - protein, 292 aa, Homo sapiens; identical to SEQ ID NO: 846289

SEQ ID NO: 846299 - protein, 191 aa, Homo sapiens
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPEPHVV

SEQ ID NO: 846300 - protein, 571 aa, Homo sapiens
RERRRRRGGARDQGPWEGERGEGRMQGPDAPLLLSARELGPGRRGSASWYRQEGGAVCNWLRKPQPLEPRTSFPSARRSEFRPPRRLPWAGPASAQSEEGHAGGRCQAGSPAPARRLSGAFKTLVPGTHAQGASDTHPLGPPHTPVLDDPSPQDGFPVLWRGSSKASHMNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPEPHVV

SEQ ID NO: 846301 - protein, 311 aa, Homo sapiens
MWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQGPAPNMQVSPERNAHCAQHHSSGSESLPEKAADRKQKVRVAPEGTDFMCNRARRSPRLSTLSRTVEVVLKGNWEATESLGGAGYTGGQQVCQRETEKKTGGKSSPGVRTKLNIFFDKERNIKIANYGFSSTFAKRDNTEKGTFDGTLPYAGPELFLGHGYQCPAINVWSLGIIVCKMVAGALPFYEQNCKDIL

SEQ ID NO: 846302 - protein, 114 aa, Homo sapiens
MHANPTTACPFPSGFSSCLQAPSPVIQGPISEGFREAEAALQEGGKSLPLPERLPHCCLLCVSCTRKAWLCARIRGTRASGVARDPMLKLLWYRSGCRGLRASVVYQNLQSSAL

SEQ ID NO: 846303 - protein, 176 aa, Homo sapiens; identical to SEQ ID NO: 785921

SEQ ID NO: 846304 - protein, 177 aa, Homo sapiens
GSQRGRAYWSLPGVGRRWASSKAARGGVRVVGLRRAPGHSPGREAELGGRDLRAAVSPAERQELRTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEVRP

SEQ ID NO: 846305 - protein, 164 aa, Homo sapiens
MWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPVTTSPASTPRPSCLLPMYSDTRARSSDDSTASWWALRPCRPQARP

SEQ ID NO: 846306 - protein, 164 aa, Homo sapiens; identical to SEQ ID NO: 846305

SEQ ID NO: 846307 - protein, 164 aa, Homo sapiens; identical to SEQ ID NO: 846305

SEQ ID NO: 846308 - protein, 246 aa, Homo sapiens
MWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEARHHFPSLHTKAQLPSPHVLRHQGQVLRRQHSKLVGTKALSTTGKALRTLPTAKVFISLPPNLDFKVAPSILKPRKVGLDL

SEQ ID NO: 846309 - protein, 164 aa, Homo sapiens; identical to SEQ ID NO: 846305

SEQ ID NO: 846310 - protein, 311 aa, Homo sapiens
MWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQGPAPNMQVSPEEMHHCAQHHSSGSESLPEKAADRKQKVRVAPEGTDFMCNRARRSPRLSTLSRTVEVVLKGNWEATESLGGAGYTGGQQVCQRETEKKTGGKSSPGVRTKLNIFFDKERNIKIANYGFSSTFAKRDNTEKGTFDGTLPYAGPELFLGHGYQCPAINVWSLGIIVCKMVAGALPFYEQNCKDIL

SEQ ID NO: 846311 - protein, 150 aa, Homo sapiens [sequence omitted]

SEQ ID NO: 846312 - protein, 401 aa, Homo sapiens
MQYLLKKYPSLTLQQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPEPHVV

SEQ ID NO: 846313 - protein, 372 aa, Homo sapiens
SASRVAGTTGARHHAWLVFCIFSRDGVSLCWPGWSRSPDLMIHPPQPPKVLGLQASATVTSLKQEQVLNSGSRVRKGRVRFWIQNGASHDQVLEPEQASSLGLSRVSPGLGAEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPEPHVV

SEQ ID NO: 846314 - protein, 288 aa, Homo sapiens
RERRRRRGGARDQGPWEGERGEGRMQGPDAPLLLSARELGPGRRGSASWYRQEGGAVCNWLRKPQPLEPRTSFPSARRSEFRPPRRLPWAGPASAQSEEGHAGGRCQAGSPAPARRLSGAFKTLVPGTHAQGASDTHPLGPPHTPVLDDPSPQDGFPVLWRGSSKASHMNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMRRGRTQAPRHSGPAL

SEQ ID NO: 846315 - protein, 164 aa, Homo sapiens; identical to SEQ ID NO: 846305

SEQ ID NO: 846316 - protein, 121 aa, Homo sapiens
MHANPTTACPFPSGFSSCLQAPSPVIQGPISEGFREAEAALQEGGKSLPLPERLPHCCLLCVSCTRKAWLCARIRGTRASGVARDPMLKLLWYRSGCRGLRASVVYQNLQSTAMFRGESGL

SEQ ID NO: 846317 - protein, 159 aa, Homo sapiens
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYMETKAEMLSAYKT

SEQ ID NO: 846318 - protein, 202 aa, Homo sapiens
MQYLLKKYPSLTLQQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIEDFWLTAARNVLKLVVKSEWKSYPIQAVEEEASGKYCGYLHSPTHLSSEAPSWKCLVASAL

SEQ ID NO: 846319 - protein, 121 aa, Homo sapiens; identical to SEQ ID NO: 846316

SEQ ID NO: 846320 - protein, 110 aa, Homo sapiens
MQYLLKKYPSLTLQQKKIFTIQGCYPVIRCLLRRRGWVEKKMVHRSGPTLLPPQKDLDSSAMGDSDTTEDEDEDEDEEFQPSQLFDFDDLLKFDDLDGTHALMVRPWGPR

SEQ ID NO: 846321 - protein, 192 aa, Homo sapiens
MQYLLKKYPSLTLQQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIGKETPSPMPEPQADRAGLKLWLILERNRPLFMPSSACPSRFPFPPSILILP

SEQ ID NO: 846322 - protein, 77 aa, Homo sapiens
NSMRKVYGKGYNVERVQTKGRLPRRQANTQDERVSKKTPFLHRLLIISLFSPPFTPRLLLSCASEAPSWKCLVASAL

SEQ ID NO: 846323 - protein, 107 aa, Homo sapiens
SKDQMINHYARAGSFTTKVGLCLNLRNLPWFDEVDANSFFPRCYCLGAEDDKKAFIGKETPSPMPEPQADRAGLKLWLILERNRPLFMPSSACPSRFPFPPSILILP

SEQ ID NO: 846324 - protein, 164 aa, Homo sapiens; identical to SEQ ID NO: 846305

SEQ ID NO: 846325 - protein, 211 aa, Homo sapiens
MWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEGKDSGTPTHSPSPLPQPPHQGPAAFSPCTPTPGPGPQTTAQQAGGH

SEQ ID NO: 846326 - protein, 164 aa, Homo sapiens; identical to SEQ ID NO: 846305

SEQ ID NO: 846327 - protein, 164 aa, Homo sapiens; identical to SEQ ID NO: 846305

SEQ ID NO: 846328 - protein, 164 aa, Homo sapiens; identical to SEQ ID NO: 846305

SEQ ID NO: 846329 - protein, 288 aa, Homo sapiens; identical to SEQ ID NO: 846314

SEQ ID NO: 846330 - protein, 164 aa, Homo sapiens; identical to SEQ ID NO: 846305

SEQ ID NO: 846331 - protein, 238 aa, Homo sapiens
NKPRTTNIEVIRLTIDLHDESMLVIAHLWNEETHKGLDLSFLFSAPAQCTCATTPSRSTWRTHAIGIHCFRQNHMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPVTTSPASTPRPSCLLPMYSDTRARSSDDSTASWWALRPCRPQARP

SEQ ID NO: 846332 - protein, 121 aa, Homo sapiens; identical to SEQ ID NO: 846316

SEQ ID NO: 846333 - protein, 205 aa, Homo sapiens
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIVIRRPIAILRRMKKHDSSGNQCNQSSQRRHMENHTTAITRFTSMTHSGKARRTAHPQD

SEQ ID NO: 846334 - protein, 121 aa, Homo sapiens; identical to SEQ ID NO: 846316

SEQ ID NO: 846335 - protein, 110 aa, Homo sapiens; identical to SEQ ID NO: 846320

SEQ ID NO: 846336 - protein, 138 aa, Homo sapiens
AGLLSAHLCPGGREIFLTYTKMMCGLEATLEASSPSCSPTLLSRAGRGCLRPCYPHWPLCFCLLLSPQSRMVQNEIPYFIWTTRRDVLDCRFLSKDQMINHYARAGSFTTKVGSLEEQAGQLPTPCPWAGSSPPCSPC

SEQ ID NO: 846337 - protein, 392 aa, Homo sapiens
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEEVWDALTDNYIPSLSEDWRDPNIEALNGNCSDTEIHEKEEEEFNEKSENDSGINEEPLLTADQVIEEIEEMMQNSPDPEEEEEVLEEEDGGETSSQADSVLLQEMQALTQTFNNNWSYEGLRHMSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQYLNTVIPYEKKASPPSVEDLQMLTNILFAMKEDNEKVPTLLTDYILKVLCPT

SEQ ID NO: 846338 - protein, 104 aa, Homo sapiens
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEE

SEQ ID NO: 846339 - protein, 363 aa, Homo sapiens
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEEVWDALTDNYIPSLSEDWRDPNIEALNGNCSDTEVIEEIEEMMQNSPDPEEEEEVLEEEDGGETSSQADSVLLQEMQALTQTFNNNWSYEGLRHMSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQYLNTVIPYEKKASPPSVEDLQMLTNILFAMKEDNEKVPTLLTDYILKVLCPT

SEQ ID NO: 846340 - protein, 292 aa, Homo sapiens
LGLLTSKLPLFFFPVLLSPPKVDFIFPNRIRQSRSGLLPNIEALNGNCSDTDIHEKEEEEFNEKSEVIEEIEEMMQNSPDPEEEEEVLEEEDGGETSSQADSVLLQEMQALTQTFNNNWSYEGLRHMSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQYLNTVIPYEKKASPPSVEDLQMLTNILFAMKEDNEKVPTLLTDYILKVLCPT

SEQ ID NO: 846341 - protein, 166 aa, Homo sapiens
MSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQYLNTVIPYEKKASPPSVEDLQMLTNILFAMKEDNEKVPTLLTDYILKVLCPT

SEQ ID NO: 846342 - protein, 392 aa, Homo sapiens; identical to SEQ ID NO: 846337

SEQ ID NO: 846343 - protein, 396 aa, Homo sapiens
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEEVWDALTDNYIPSLSEDWRDPNIEALNGNCSDTEIHEKEEEEFNEKSENDSGINEEPLLTADQVIEEIEEMMQNSPDPEEEEEVLEEEDGGETSSQADSVLLQEMQALTQTFNNNWSYEGLRHMSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQVRVVSLLQALFLDSCSLASPATQGDSDSPELSQHLFRGLGVLTLFSPLKEEQRISF

SEQ ID NO: 846344 - protein, 180 aa, Homo sapiens
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEEVWDALTDNYIPSLSEDWRDPNIEALNGNCSDTEIHEKEEEEFNEKSENDSGINEEPLLTADQIVIEEMMQNSPVLV

SEQ ID NO: 846345 - protein, 392 aa, Homo sapiens; identical to SEQ ID NO: 846337

SEQ ID NO: 846346 - protein, 218 aa, Homo sapiens
MQNSPDPEEEEEVLEEEDGGETSSQADSVLLQEMQALTQTFNNNWSYEGLRHMSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQYLNTVIPYEKKASPPSVEDLQMLTNILFAMKEDNEKVPTLLTDYILKVLCPT

SEQ ID NO: 846347 - protein, 166 aa, Homo sapiens; identical to SEQ ID NO: 846341

SEQ ID NO: 846348 - protein, 127 aa, Homo sapiens
LCKPVSYTYCLVTEPWGVIWDSLVAERSLGVVTVSKKHLPFLSLSPPQRFSMEGISNILQSGIRQTFGSSGTDKQYLNTVIPYEKKASPPSVEDLQMLTNILFAMKEDNEKVPTLLTDYILKVLCPT

SEQ ID NO: 846349 - protein, 294 aa, Homo sapiens
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEEVWDALTDNYIPSLSEDWRDPNIEALNGNCSDTEIHEKEEEEFNEKSENDSGINEEPLLTADQVIEEIEEMMQNSPDPEEEEEVLEEEDGGETSSQADSVLLQEMQALTQTFNNNWSYEGEGPGRWAGRGGSTCSGPGSGLCALYMANRTLTASEQSLADLGGQQYLSYSASGEKFAFLRKEQGSRAKFKC

SEQ ID NO: 846350 - protein, 74 aa, Homo sapiens
VGDLEDPVDEEVLEKCPAPILFKCDQVKVCARAQGSSEPGLPPTGHSALCASIQTCVEVPADGEDRPAAVHPGR

SEQ ID NO: 846351 - protein, 1083 aa, Homo sapiens
MFSFEGDFKTRPKVSLGGASRKEEKASLLHRTQEERRKREEERRRLKNAIIIQSFIRGYRDRKQQYSIQRSAFDRCATLSQSGGAFPIANGPNLTLLVRQLLFFYKQNEDSKRLIWLYQNLIKHSSLFVKQLDGSERLTCLFQIKRLMSLCCRLLQNCNDDSLNVALPMRMLEVFSSENTYLPVLQDASYVVSVIEQILHYMIHNGYYRSLYLLINSKLPSSIEYSDLSRVPIAKILLENVLKPLHFTYNSCPEGARQQVFTAFTEEFLAAPFTDQIFHFIIPALADAQTVFPYEPFLNALLLIESRCSRKSGGAPWLFYFVLTVGENYLGALSEEGLLVYLRVLQTFLSQLPVSPASASCHDSASDSEEESEEADKPSSPEDGRLSVSYITEECLKKLDTKQQTNTLLNLVWRDSASEEVFTTMASVCHTLMVQHRMMVPKVRLLYSLAFNARFLRHLWFLISSMSTRMITGSMVPLLQVISRGSPMSFEDSSRIIPLFYLFSSLFSHSLISIHDNEFFGDPIEVVGQRQSSMMPFTLEELIMLSRCLRDACLGIIKLAYPETKPEVREEYITAFQSIGVTTSSEMQQCIQMEQKRWIQLFKVITNLVKMLKSRDTRRNFCPPNHWLSEQEDIKADKVTQLYVPASRHVWRFRRMGRIGPLQSTLDVGLESPPLSVSEERQLAVLTELPFVVPFEERVKIFQRLIYADKQEVQGDGPFLDGINVTIRRNYIYEDAYDKLSPENEPDLKKRIRVHLLNAHGLDEAGIDGGGIFREFLNELLKSGFNPNQGFFKTTNEGLLYPNPAAQMLVGDSFARHYYFLGRMLGKALYENMLVELPFAGFFLSKLLGTSADVDIHHLASLDPEVYKNLLFLKSYEDDVEELGLNFTVVNNDLGEAQVVELKFGGKDIPVTSANRIAYIHLVADYRLNRQIRQHCLAFRQGLANVVSLEWLRMFDQQEIQVLISGAQVPISLEDLKSFTNYSGGYSADHPVIKVFWRVVEGFTDEEKRKLLKFVTSCSRPPLLGFKELYPAFCIHNGGSDLERLPTASTCMNLLKLPEFYDETLLRSKLLYAIECAAGFELS

SEQ ID NO: 846352 - protein, 1083 aa, Homo sapiens; identical to SEQ ID NO: 846351

SEQ ID NO: 846353 - protein, 475 aa, Homo sapiens
VIPTSYPTTRRNFCPPNHWLSEQEDIKADKVTQLYVPASRHVWRFRRMGRIGPLQSTLDVGLESPPLSVSEERQLAVLTELPFVVPFEERVKIFQRLIYADKQEVQGDGPFLDGINVTIRRNYIYEDAYDKLSPENEPDLKKRIRVHLLNAHGLDEAGIDGGGIFREFLNELLKSGFNPNQGFFKTTNEGLLYPNPAAQMLVGDSFARHYYFLGRMLGKALYENMLVELPFAGFFLSKLLGTSADVDIHHLASLDPEVYKNLLFLKSYEDDVEELGLNFTVVNNDLGEAQVVELKFGGKDIPVTSANRIAYIHLVADYRLNRQIRQHCLAFRQGLANVVSLEWLRMFDQQEIQVLISGAQVPISLEDLKSFTNYSGGYSADHPVIKVFWRVVEGFTDEEKRKLLKFVTSCSRPPLLGFKELYPAFCIHNGGSDLERLPTASTCMNLLKLPEFYDETLLRSKLLYAIECAAGFELS

SEQ ID NO: 846354 - protein, 1083 aa, Homo sapiens; identical to SEQ ID NO: 846351

SEQ ID NO: 846355 - protein, 1083 aa, Homo sapiens; identical to SEQ ID NO: 846351

SEQ ID NO: 846356 - protein, 1083 aa, Homo sapiens; identical to SEQ ID NO: 846351

SEQ ID NO: 846357 - protein, 130 aa, Homo sapiens
MFDQQEIQVLISGAQVPISLEDLKSFTNYSGGYSADHPVIKVFWRVVEGFTDEEKRKLLKFVTSCSRPPLLGFKELYPAFCIHNGGSDLERLPTASTCMNLLKLPEFYDETLLRSKLLYAIECAAGFELS

SEQ ID NO: 846358 - protein, 73 aa, Homo sapiens
AVGEASLLAVRAPTQFQELYPAFCIHNGGSDLERLPTASTCMNLLKLPEFYDETLLRSKLLYAIECAAGFELS

SEQ ID NO: 846359 - protein, 126 aa, Homo sapiens
EKPARYRVCAPETVTRLASREQHQEEEGLPSYCNICHPLYPVTWGRTDTVVSLKLFEPKWRLHLCPDASRAGLPSSARPPFPWAAPTCLPGYLGVTRHAWHPLLPGAALTRRRDSPWCTSREEERR

SEQ ID NO: 846360 - protein, 649 aa, Homo sapiens
MFSFEGDFKTRPKVSLGGASRKEEKASLLHRTQEERRKREEERRRLKNAIIIQSFIRGYRDRKQQYSIQRSAFDRCATLSQSGGAFPIANGPNLTLLVRQLLFFYKQNEDSKRLIWLYQNLIKHSSLFVKQLDGSERLTCLFQIKRLMSLCCRLLQNCNDDSLNVALPMRMLEVFSSENTYLPVLQDASYVVSVIEQILHYMIHNGYYRSLYLLINSKLPSSIEYSDLSRVPIAKILLENVLKPLHFTYNSCPEGARQQVFTAFTEEFLAAPFTDQIFHFIIPALADAQTVFPYEPFLNALLLIESRCSRKSGGAPWLFYFVLTVGENYLGALSEEGLLVYLRVLQTFLSQLPVSPASASCHDSASDSEEESEEADKPSSPEDGRLSVSYITEECLKKLDTKQQTNTLLNLVWRDSASEEVFTTMASVCHTLMVQHRMMVPKVRLLYSLAFNARFLRHLWFLISSMSTRMITGSMVPLLQVISRGSPMSFEDSSRIIPLFYLFSSLFSHSLISIHDNEFFGDPIEVVGQRQSSMMPFTLEELIMLSRCLRDACLGIIKLAYPETKPEVREEYITAFQSIGVTTSSEMQQCIQMEQKRWIQLFKVITNLVKMLKSRDTRRNFCPPNHWLSEQEDIKADKVLLKDLFNIYH

SEQ ID NO: 846361 - protein, 927 aa, Homo sapiens
MFSFEGDFKTRPKVSLGGASRKEEKASLLHRTQEERRKREEERRRLKNAIIIQSFIRGYRDRKQQYSIQRSAFDRCATLSQSGGAFPIANGPNLTLLVRQLLFFYKQNEDSKRLIWLYQNLIKHSSLFVKQLDGSERLTCLFQIKRLMSLCCRLLQNCNDDSLNVALPMRMLEVFSSENTYLPVLQDASYVVSVIEQILHYMIHNGYYRSLYLLINSKLPSSIEYSDLSRVPIAKILLENVLKPLHFTYNSCPEGARQQVFTAFTEEFLAAPFTDQIFHFIIPALADAQTVFPYEPFLNALLLIESRCSRKSGGAPWLFYFVLTVGENYLGALSEEGLLVYLRVLQTFLSQLPVSPASASCHDSASDSEEESEEADKPSSPEDGRLSVSYITEECLKKLDTKQQTNTLLNLVWRDSASEEVFTTMASVCHTLMVQHRMMVPKVRLLYSLAFNARFLRHLWFLISSMSTRMITGSMVPLLQVISRGSPMSFEDSSRIIPLFYLFSSLFSHSLISIHDNEFFGDPIEVVGQRQSSMMPFTLEELIMLSRCLRDACLGIIKLAYPETKPEVREEYITAFQSIGVTTSSEMQQCIQMEQKRWIQLFKVITNLVKMLKSRDTRRNFCPPNHWLSEQEDIKADKVTQLYVPASRHVWRFRRMGRIGPLQSTLDVGLESPPLSVSEERQLAVLTELPFVVPFEERVKIFQRLIYADKQEVQGDGPFLDGINVTIRRNYIYEDAYDKLSPENEPDLKKRIRVHLLNAHGLDEAGIDGGGIFREFLNELLKSGFNPNQGFFKTTNEGLLYPNPAAQMLVGDSFARHYYFLGRMLGKALYENMLVELPFAGFFLSKLLGTSADVDIHHLASLDPEVYKNLLFLKSYEDDVEELGLNFTVVNNDLGEAQVRGQEEDSHTCIASSSISLCVEVHLCYSV

SEQ ID NO: 846362 - protein, 829 aa, Homo sapiens [sequence omitted]

SEQ ID NO: 846363 - protein, 604 aa, Homo sapiens
MFSFEGDFKTRPKVSLGGASRKEEKASLLHRTQEERRKREEERRRLKNAIIIQSFIRGYRDRKQQYSIQRSAFDRCATLSQSGGAFPIANGPNLTLLVRQLLFFYKQNEDSKRLIWLYQNLIKHSSLFVKQLDGSERLTCLFQIKRLMSLCCRLLQNCNDDSLNVALPMRMLEVFSSENTYLPVLQDASYVVSVIEQILHYMIHNGYYRSLYLLINSKLPSSIEYSDLSRVPIAKILLENVLKPLHFTYNSCPEGARQQVFTAFTEEFLAAPFTDQIFHFIIPALADAQTVFPYEPFLNALLLIESRCSRKSGGAPWLFYFVLTVGENYLGALSEEGLLVYLRVLQTFLSQLPVSPASASCHDSASDSEEESEEADKPSSPEDGRLSVSYITEECLKKLDTKQQTNTLLNLVWRDSASEEVFTTMASVCHTLMVQHRMMVPKVRLLYSLAFNARFLRHLWFLISSMSTRMITGSMVPLLQVISRGSPMSFEDSSRIIPLFYLFSSLFSHSLISIHDNEFFGDPIEVVGQRQSSMMPFTLEELIMLSRCLRDACLGIIKLAYPETKPEVREEYITAFQSIGVTTSSEMQQCIQMEQKRWIQLFKV

SEQ ID NO: 846364 - protein, 1083 aa, Homo sapiens; identical to SEQ ID NO: 846351

SEQ ID NO: 846365 - protein, 1083 aa, Homo sapiens; identical to SEQ ID NO: 846351

SEQ ID NO: 846366 - protein, 1083 aa, Homo sapiens; identical to SEQ ID NO: 846351

SEQ ID NO: 846367 - protein, 428 aa, Homo sapiens [sequence omitted]

SEQ ID NO: 846368 - protein, 251 aa, Homo sapiens [sequence omitted]

SEQ ID NO: 846369 - protein, 1083 aa, Homo sapiens; identical to SEQ ID NO: 846351

SEQ ID NO: 846370 - protein, 1083 aa, Homo sapiens; identical to SEQ ID NO: 846351

SEQ ID NO: 846371 - protein, 1083 aa, Homo sapiens; identical to SEQ ID NO: 846351

SEQ ID NO: 846372 - protein, 989 aa, Homo sapiens
MFSFEGDFKTRPKVSLGGASRKEEKASLLHRTQEERRKREEERRRLKNAIIIQSFIRGYRDRKQQYSIQRSAFDRCATLSQSGGAFPIANGPNLTLLVRQLLFFYKQNEDSKRLIWLYQNLIKHSSLFVKQLDGSERLTCLFQIKRLMSLCCRLLQNCNDDSLNVALPMRMLEVFSSENTYLPVLQDASYVVSVIEQILHYMIHNGYYRSLYLLINSKLPSSIEYSDLSRVPIAKILLENVLKPLHFTYNSCPEGARQQVFTAFTEEFLAAPFTDQIFHFIIPALADAQTVFPYEPFLNALLLIESRCSRKSGGAPWLFYFVLTVGENYLGALSEEGLLVYLRVLQTFLSQLPVSPASASCHDSASDSEEESEEADKPSSPEDGRLSVSYITEECLKKLDTKQQTNTLLNLVWRDSASEEVFTTMASVCHTLMVQHRMMVPKVRLLYSLAFNARFLRHLWFLISSMSTRMITGSMVPLLQVISRGSPMSFEDSSRIIPLFYLFSSLFSHSLISIHDNEFFGDPIEVVGQRQSSMMPFTLEELIMLSRCLRDACLGIIKLAYPETKPEVREEYITAFQSIGVTTSSEMQQCIQMEQKRWIQLFKVITNLVKMLKSRDTRRNFCPPNHWLSEQEDIKADKVTQLYVPASRHVWRFRRMGRIGPLQSTLDVGLESPPLSVSEERQLAVLTELPFVVPFEERVKIFQRLIYADKQEVQGDGPFLDGINVTIRRNYIYEDAYDKLSPENEPDLKKRIRVHLLNAHGLDEAGIDGGGIFREFLNELLKSGFNPNQGFFKTTNEGLLYPNPAAQMLVGDSFARHYYFLGRMLGKALYENMLVELPFAGFFLSKLLGTSADVDIHHLASLDPEVYKNLLFLKSYEDDVEELGLNFTVVNNDLGEAQVVELKFGGKDIPVTSANRIAYIHLVADYRLNRQIRQHCLAFRQGLANVVSLEWLRMFDQQEIQVPYLLTFWDTLVTGNEQAFLKFTSNVII

SEQ ID NO: 846373 - protein, 924 aa, Homo sapiens
MFSFEGDFKTRPKVSLGGASRKEEKASLLHRTQEERRKREEERRRLKNAIIIQSFIRGYRDRKQQYSIQRSAFDRCATLSQSGGAFPIANGPNLTLLVRQLLFFYKQNEDSKRLIWLYQNLIKHSSLFVKQLDGSERLTCLFQIKRLMSLCCRLLQNCNDDSLNVALPMRMLEVFSSENTYLPVLQDASYVVSVIEQILHYMIHNGYYRSLYLLINSKLPSSIEYSDLSRVPIAKILLENVLKPLHFTYNSCPEGARQQVFTAFTEEFLAAPFTDQIFHFIIPALADAQTVFPYEPFLNALLLIESRCSRKSGGAPWLFYFVLTVGENYLGALSEEGLLVYLRVLQTFLSQLPVSPASASCHDSASDSEEESEEADKPSSPEDGRLSVSYITEECLKKLDTKQQTNTLLNLVWRDSASEEVFTTMASVCHTLMVQHRMMVPKVRLLYSLAFNARFLRHLWFLISSMSTRMITGSMVPLLQVISRGSPMSFEDSSRIIPLFYLFSSLFSHSLISIHDNEFFGDPIEVVGQRQSSMMPFTLEELIMLSRCLRDACLGIIKLAYPETKPEVREEYITAFQSIGVTTSSEMQQCIQMEQKRWIQLFKVITNLVKMLKSRDTRRNFCPPNHWLSEQEDIKADKVTQLYVPASRHVWRFRRMGRIGPLQSTLDVGLESPPLSVSEERQLAVLTELPFVVPFEERVKIFQRLIYADKQEVQGDGPFLDGINVTIRRNYIYEDAYDKLSPENEPDLKKRIRVHLLNAHGLDEAGIDGGGIFREFLNELLKSGFNPNQGFFKTTNEGLLYPNPAAQMLVGDSFARHYYFLGRMLGKALYENMLVELPFAGFFLSKLLGTSADVDIHHLASLDPEVYKNLLFLKSYEDDVEELGLNFTVVNNDLGEAQVKDLYTVGIGAQSIEMVVLELNSSRK

SEQ ID NO: 846374 - protein, 676 aa, Homo sapiens [sequence omitted]

SEQ ID NO: 846375 - protein, 95 aa, Homo sapiens
MEPNPATPLTLTTRRAPTKKHEHQTTSAAQATNRTGSEDNTEQQPGRARQQRSGMRKKRTKTQTAIGQDTKRTANDGQHTTRPRGKQEHETPSHN

SEQ ID NO: 846376 - protein, 110 aa, Homo sapiens
MLIKVKTLTGKEIEIDIEPTDKVERIKERVEEKEGIPPQQQRLIYSGKQMNDEKTAADYKMLSKMGWCGWVKAPTPWLPASRLDKAGGYFSLPSVPVFPLKACGIFPPSP

SEQ ID NO: 846377 - protein, 85 aa, Homo sapiens
MTTRRAPTKKHEHQTTSAAQATNRTGSEDNTEQQPGRARQQRSGMRKKRTKTQTAIGQDTKRTANDGQHTTRPRGKQEHETPSHN

SEQ ID NO: 846378 - protein, 72 aa, Homo sapiens
NQSGECVQSVPAFLSLASWTSLTSLAEARLVTAALVLATSHGFLHLHLSTPVVVLHQFPALVSPICCFLFCA

SEQ ID NO: 846379 - protein, 80 aa, Homo sapiens
REESSKQQGSKCKGPCRSELGILEGQREAGATGGSSETIKCQQGDYPSAPLKDCKKEDTKSMAFFPLGKKGDNEKPPLAN

SEQ ID NO: 846380 - protein, 477 aa, Homo sapiens
MAAPILRSFSWGRWSGTLNLSVLLPLGLRKAHSGAQGLLAAQKARGLFKDFFPETGTKIELPELFDRGTASFPQTIYCGFDPTADSLHVGHLLALLGLFHLQRAGHNVIALVGGATARLGDPSGRTKEREALETERVRANARALRLGLEALAANHQQLFTDGRSWGSFTVLDNSAWYQKQHLVDFLAAVGGHFRMGTLLSRQSVQLRLKSPEGMSLAEFFYQVLQAYDFYYLFQRYGCRVQLGGSDQLGNIMSGYEFINKLTGEDVFGITVPLITSTTGAKLGKSAGNAVWLNRDKTSPFELYQFFVRQPDDSVERYLKLFTFLPLPEIDHIMQLHVKEPERRGPQKRLAAEVTKLVHGREGLDSAKRCTQALYHSSIDALEVMSDQELKELFKEAPFSEFFLDPGTSVLDTCRKANAIPDGPRGYRMITEGGVSINHQQVTNPESVLIVGQHILKNGLSLLKIGKRNFYIIKWLQL

SEQ ID NO: 846381 - protein, 477 aa, Homo sapiens; identical to SEQ ID NO: 846380

SEQ ID NO: 846382 - protein, 477 aa, Homo sapiens; identical to SEQ ID NO: 846380

SEQ ID NO: 846383 - protein, 477 aa, Homo sapiens; identical to SEQ ID NO: 846380

SEQ ID NO: 846384 - protein, 401 aa, Homo sapiens
QARCPEPRRRQWPGRHRPEKSAAELGANPPPPTWGTGQVRPGEGGSAGREGEVSVRPAPTSFSVPSLPCLEAARLLSSEFYSAWVSAQCRWWPVLVVPLYLGKSGAAAMATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 846385 - protein, 293 aa, Homo sapiens
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 846386 - protein, 293 aa, Homo sapiens; identical to SEQ ID NO: 846385

SEQ ID NO: 846387 - protein, 401 aa, Homo sapiens; identical to SEQ ID NO: 846384

SEQ ID NO: 846388 - protein, 333 aa, Homo sapiens
RPGAQSPGGGSGQEGTGLRSLRLSWEQIPHPLPGGQGAAAMATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 846389 - protein, 424 aa, Homo sapiens
KNCHDTESPHLRFSDADGKEYDFGTQLPSSSPGSLKVDDTGKKIFAVSGLISDGKPHRSPEDRNDRCKKKAAALFDSQAPICPICQVLLRPSELQEHMEQELEQLAQLPSSKNSLLKDAMAPGTPKSLLLSASIKREGESPTASPHSSATDDLHHSDRYQTFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 846390 - protein, 188 aa, Homo sapiens
MKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTGNGEGTHSQRALRKDLQKQRLGNPRAFRVTRWGSRVGQTLTGYPWDRNA

SEQ ID NO: 846391 - protein, 245 aa, Homo sapiens
MKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 846392 - protein, 290 aa, Homo sapiens
WGGGQDCRPRLTLSFLFLHLPAIFSQTFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLVRWHGGRGMGGRSGHCPDVCAYA

SEQ ID NO: 846393 - protein, 245 aa, Homo sapiens; identical to SEQ ID NO: 846391

SEQ ID NO: 846394 - protein, 245 aa, Homo sapiens; identical to SEQ ID NO: 846391

SEQ ID NO: 846395 - protein, 450 aa, Homo sapiens
KNCHDTESPHLRFSDADGKEYDFGTQLPSSSPGSLKVDDTGKKIFAVSGLISDGKPHRSPEDRNDRCKKKAAALFDSQAPICPICQVLLRPSELQEHMEQELEQLAQLPSSKNSLLKDAMAPGTPKSLLLSASIKREGESPTASPHSSATDDLHHSDRYQTFLRVRANRQTRLNARIGKMKRRKQDEGQVCPLCNRPLAGSEQEMSRHVEHCLSKREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 846396 - protein, 213 aa, Homo sapiens
KATLVRPWMLRIGPPLSWKVASGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 846397 - protein, 200 aa, Homo sapiens
MRAHLWKWFGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 846398 - protein, 172 aa, Homo sapiens
MGQGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 846399 - protein, 226 aa, Homo sapiens
MWSIAFLRGKAPAWLRMMLWTSSMRTTTALRSMSGVDRSGYGPPLSWKVASEALASSCAAAKRTRTVMLTWMWMGMTLWSMGSHTKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 846400 - protein, 245 aa, Homo sapiens; identical to SEQ ID NO: 846391

SEQ ID NO: 846401 - protein, 245 aa, Homo sapiens; identical to SEQ ID NO: 846391

SEQ ID NO: 846402 - protein, 281 aa, Homo sapiens
MKRRKQDEGQVCPLCNRPLAGSEQEMSRHVEHCLSKREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKLTDEFKAVNHRIGGASETGLGANRSNPLARRTYSLVGTALQQVRNARHGPRQHEVAHKVILSVCHVHHPAATLRCSPPLSPNSDHEYTVQSARS

SEQ ID NO: 846403 - protein, 104 aa, Homo sapiens
MSFIGESNFSSDPIPSPWAPSALKQEGPGPSCSLLPLGSPQLLQRSVQGPAHLQCPPSSLEEQGLTPPTRSDSRIGWVPRVSDLLNSPALGRGKGELSASWPPA

SEQ ID NO: 846404 - protein, 245 aa, Homo sapiens
MKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLVRWHGGRGMGGRSGHCPDVCAYA

SEQ ID NO: 846405 - protein, 271 aa, Homo sapiens
MKRRKQDEGQVCPLCNRPLAGSEQEMSRHVEHCLSKREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 846406 - protein, 271 aa, Homo sapiens; identical to SEQ ID NO: 846405

SEQ ID NO: 846407 - protein, 186 aa, Homo sapiens
MCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 846408 - protein, 186 aa, Homo sapiens; identical to SEQ ID NO: 846407

SEQ ID NO: 846409 - protein, 245 aa, Homo sapiens; identical to SEQ ID NO: 846391

SEQ ID NO: 846410 - protein, 245 aa, Homo sapiens; identical to SEQ ID NO: 846391

SEQ ID NO: 846411 - protein, 104 aa, Homo sapiens; identical to SEQ ID NO: 846403

SEQ ID NO: 846412 - protein, 598 aa, Homo sapiens
MKPTGTDPRILSIAAEVAKSPEQNVPVILLKLKEIINITPLGSSELKKIKQDIYCYDLIQYCLLVLSQDYSRIQGGWTTISQLTQILSHCCVGLEPGEDAEEFYNELLPSAAENFLVLGRQLQTCFINAAKAEEKDELLHFFQIVTDSLFWLLGGHVELIQNVLQSDHFLHLLQADNVQIGSAVMMMLQNILQINSGDLLRIGRKALYSILDEVIFKLFSTPSPVIRSTATKLLLLMAESHQEILILLRQSTCYKGLRRLLSKQETGTEFSQELRQLVGLLSPMVYQEVEEQKLHQAACLIQAYWKGFQTRKRLKKLPSAVIALQRSFRSKRSKMLLEINRQKEEEDLKLQLQLQRQRAMRLSRELQLSMLEIVHPGQVEKHYREMEEKSALIIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 846413 - protein, 466 aa, Homo sapiens
MKPTGTDPRILSIAAEVAKSPEQNVPVILLKLKEIINITPLGSSELKKIKQDIYCYDLIQYCLLVLSQDYSRIQGGWTTISQLTQILSHCCVGLEPGEDAEEFYNELLPSAAENFLVLGRQLQTCFINAAKAEEKDELLHFFQIVTDSLFWLLGGHVELIQNVLQSDHFLHLLQADNVQIGSAVMMMLQNILQINSRSKRSKMLLEINRQKEEEDLKLQLQLQRQRAMRLSRELQLSMLEIVHPGQVEKHYREMEEKSALIIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 846414 - protein, 598 aa, Homo sapiens; identical to SEQ ID NO: 846412

SEQ ID NO: 846415 - protein, 414 aa, Homo sapiens
MMMLQNILQINSGDLLRIGRKALYSILDEVIFKLFSTPSPVIRSTATKLLLLMAESHQEILILLRQSTCYKGLRRLLSKQETGTEFSQELRQLVGLLSPMVYQEVEEQKLHQAACLIQAYWKGFQTRKRLKKLPSAVIALQRSFRSKRSKMLLEINRQKEEEDLKLQLQLQRQRAMRLSRELQLSMLEIVHPGQVEKHYREMEEKSALIIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 846416 - protein, 598 aa, Homo sapiens; identical to SEQ ID NO: 846412

SEQ ID NO: 846417 - protein, 414 aa, Homo sapiens; identical to SEQ ID NO: 846415

SEQ ID NO: 846418 - protein, 573 aa, Homo sapiens
FVAVLLITGLGVEKSLKITSSKIEYRAFLPILSKSPLLICNIFCSIIMLQILFGHCQLAQILSHCCVGLEPGEDAEEFYNELLPSAAENFLVLGRQLQTCFINAAKAEEKDELLHFFQIVTDSLFWLLGGHVELIQNVLQSDHFLHLLQADNVQIGSAVMMMLQNILQINSGDLLRIGRKALYSILDEVIFKLFSTPSPVIRSTATKLLLLMAESHQEILILLRQSTCYKGLRRLLSKQETGTEFSQELRQLVGLLSPMVYQEVEEQKLHQAACLIQAYWKGFQTRKRLKKLPSAVIALQRSFRSKRSKMLLEINRQKEEEDLKLQLQLQRQRAMRLSRELQLSMLEIVHPGQVEKHYREMEEKSALIIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 846419 - protein, 140 aa, Homo sapiens
PWSLVFCTSRDGFSLQSLYRRMEGCSGPVLLVLRDQDGQIFGAFSSSAIRLSKGFYGTGETFLFSFSPQLKVFKWTGSNSFFVKGDLDSLMMGSGSGRFGLWLDGDLFRGGSSPCPTFNNEVLARQEQFCIQELEAWLLS

SEQ ID NO: 846420 - protein, 140 aa, Homo sapiens; identical to SEQ ID NO: 846419

SEQ ID NO: 846421 - protein, 98 aa, Homo sapiens
PWSLVFCTSRDGFSLQSLYRRMEGCSGPVLLVLRDQDGQIFGAFSSSAIRLSKGFYGTGETFLFSFSPQLKVFKWTGSNSFFVKGDLDSLMMGSGRIL

SEQ ID NO: 846422 - protein, 137 aa, Homo sapiens
MVHLTTLLCKAYRGGHLTIRLALGGCTNRPFYRIVAAHNKCPRDGRFVEQLGSYDPLPNSHGEKLVALNLDRIRHWIGCGAHLSKPMEKLLGLAGFFPLHPMMITNAERLRRKRAREVLLASQKTDAEATDTEATET

SEQ ID NO: 846423 - protein, 137 aa, Homo sapiens; identical to SEQ ID NO: 846422

SEQ ID NO: 846424 - protein, 137 aa, Homo sapiens; identical to SEQ ID NO: 846422

SEQ ID NO: 846425 - protein, 137 aa, Homo sapiens; identical to SEQ ID NO: 846422

SEQ ID NO: 846426 - protein, 137 aa, Homo sapiens; identical to SEQ ID NO: 846422

SEQ ID NO: 846427 - protein, 120 aa, Homo sapiens
SGRQAEEAWRADHPLPESRFSGLYRLAVRPGVGLQVLSVFVLCPAKAVELVRAGSGALRGAARRRHHGPPHYSPLQGLPWGPLNHPPCPGWLHQSAVLPHCGCSQQVSQGWPFRRAAGLL

SEQ ID NO: 846428 - protein, 137 aa, Homo sapiens; identical to SEQ ID NO: 846422

SEQ ID NO: 846429 - protein, 137 aa, Homo sapiens; identical to SEQ ID NO: 846422

SEQ ID NO: 846430 - protein, 137 aa, Homo sapiens; identical to SEQ ID NO: 846422

SEQ ID NO: 846431 - protein, 137 aa, Homo sapiens; identical to SEQ ID NO: 846422

SEQ ID NO: 846432 - protein, 137 aa, Homo sapiens; identical to SEQ ID NO: 846422

SEQ ID NO: 846433 - protein, 327 aa, Homo sapiens [sequence omitted]

SEQ ID NO: 846434 - protein, 310 aa, Homo sapiens
MAFAPPKNTDGPKMQTKMSTWTPLNHQLLNDRVFEERRALLGKWFDKWTDSQRRRILTGLLERCSLSQQKFCCRKLQEKIPAEALDFTTKLPRVLSLYIFSFLDPRSLCRCAQVCWHWKNLAELDQLWMLKCLRFNWYINFSPTPFEQGIWKKHYIQMVKELHITKPKTPPKDGFVIADVQLVTSNSPEEKQSPLSAFRSSSSLRKKNNSGEKALPPWRSSDKHPTDIIRFNYLDNRDPMETVQQGRRKRNQMTPDFSRQSHDKKNKLQDRTRLRKAQSMVSIVYERFITITLMKISRSLILFAKLNSFI

SEQ ID NO: 846435 - protein, 315 aa, Homo sapiens
MAFAPPKNTDGPKMQTKMSTWTPLNHQLLNDRFDKWTDSQRRRILTGLLERCSLSQQKFCCRKLQEKIPAEALDFTTKLPRVLSLYIFSFLDPRSLCRCAQVCWHWKNLAELDQLWMLKCLRFNWYINFSPTPFEQGIWKKHYIQMVKELHITKPKTPPKDGFVIADVQLVTSNSPEEKQSPLSAFRSSSSLRKKNNSGEKALPPWRSSDKHPTDIIRFNYLDNRDPMETVQQGRRKRNQMTPDFSRQSHDKKNKLQDRTRLRKAQSMMSLSASSPLKVPAHLAWPPPESVGLPDTATTAEILMQHPHRHPGPQA

SEQ ID NO: 846436 - protein, 186 aa, Homo sapiens
MAFAPPKNTDGPKMQTKMSTWTPLNHQLLNDRVFEERRALLGKWFDKWTDSQRRRILTGLLERCSLSQQKFCCRKLQEKIPAEALDFTTKLPRVLSLYIFSFLDPRSLCRCAQVCWHWKNLAELDQLWMLKCLRFNWYINFSPTPFEQGIWKKHYIQMVKELHITKPKVNFRQKATSLQTLALCKF

SEQ ID NO: 846437 - protein, 116 aa, Homo sapiens [sequence omitted]

SEQ ID NO: 846438 - protein, 854 aa, Homo sapiens
GRGLGTVGAAVCGEAAAGVMAELSEEALLSVLPTIRVPKAGDRVHKDECAFSFDTPESEGGLYICMNTFLGFGKQYVERHFNKTGQRVYLHLRRTRRPKEEDPATGTGDPPRKKPTRLAIGVEGGFDLSEEKFELDEDVKIVILPDYLEIARDGLGGLPDIVRDRVTSAVEALLSADSASRKQEVQAWDGEVRQVSKHAFSLKQLDNPARIPPCGWKCSKCDMRENLWLNLTDGSILCGRRYFDGSGGNNHAVEHYRETGYPLAVKLGTITPDGADVYSYDEDDMVLDPSLAEHLSHFGIDMLKMQKTDKTMTELEIDMNQRIGEWELIQESGVPLKPLFGPGYTGIRNLGNSCYLNSVVQVLFSIPDFQRKYVDKLEKIFQNAPTDPTQDFSTQVAKLGHGLLSGEYSKPVPESGDGERVPEQKEVQDGIAPRMFKALIGKGHPEFSTNRQQDAQEFFLHLINMVERNCRSSENPNEVFRFLVEEKIKCLATEKVKYTQRVDYIMQLPVPMDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKAPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 846439 - protein, 854 aa, Homo sapiens; identical to SEQ ID NO: 846438

SEQ ID NO: 846440 - protein, 854 aa, Homo sapiens; identical to SEQ ID NO: 846438

SEQ ID NO: 846441 - protein, 349 aa, Homo sapiens
MQLPVPMDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKAPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 846442 - protein, 343 aa, Homo sapiens
MDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKAPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 846443 - protein, 377 aa, Homo sapiens
MCQGCFGRVEELKYGHRASRERLRRQRSSTLRRIHQPILSPEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKAPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 846444 - protein, 161 aa, Homo sapiens
STDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 846445 - protein, 72 aa, Homo sapiens
EVPLLTQTDKTMTELEIDMNQRIGEWELIQESGVPLKPLFGPGYTGIRNLGNSCYLNSVVQVLFSIPDFQRK

SEQ ID NO: 846446 - protein, 877 aa, Homo sapiens
GRGLGTVGAAVCGEAAAGVMAELSEEALLSVLPTIRVPKAGDRVHKDECAFSFDTPESEGGLYICMNTFLGFGKQYVERHFNKTGQRVYLHLRRTRRPKEEDPATGTGDPPRKKPTRLAIGVEGGFDLSEEKFELDEDVKIVILPDYLEIARDGLGGLPDIVRDRVTSAVEALLSADSASRKQEVQAWDGEVRQVSKHAFSLKQLDNPARIPPCGWKCSKCDMRENLWLNLTDGSILCGRRYFDGSGGNNHAVEHYRETGYPLAVKLGTITPDGADVYSYDEDDMVLDPSLAEHLSHFGIDMLKMQKTDKTMTELEIDMNQRIGEWELIQESGVPLKPLFGPGYTGIRNLGNSCYLNSVVQVLFSIPDFQRKYVDKLEKIFQNAPTDPTQDFSTQVAKLGHGLLSGEYSKPVPESGDGERVPEQKEVQDGIAPRMFKALIGKGHPEFSTNRQQDAQEFFLHLINMVERNCRSSENPNEVFRFLVEEKIKCLATEKVKYTQRVDYIMQLPVPMDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKGSLGFYGNEDEDSFCSPHFSSPTSPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 846447 - protein, 854 aa, Homo sapiens; identical to SEQ ID NO: 846438

SEQ ID NO: 846448 - protein, 661 aa, Homo sapiens
ASRGLGVNSPRVGHLRRILPGGWKCSKCDMRENLWLNLTDGSILCGRRYFDGSGGNNHAVEHYRETGYPLAVKLGTITPDGADVYSYDEDDMVLDPSLAEHLSHFGIDMLKMQKTDKTMTELEIDMNQRIGEWELIQESGVPLKPLFGPGYTGIRNLGNSCYLNSVVQVLFSIPDFQRKYVDKLEKIFQNAPTDPTQDFSTQVAKLGHGLLSGEYSKPVPESGDGERVPEQKEVQDGIAPRMFKALIGKGHPEFSTNRQQDAQEFFLHLINMVERNCRSSENPNEVFRFLVEEKIKCLATEKVKYTQRVDYIMQLPVPMDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKAPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 846449 - protein, 343 aa, Homo sapiens; identical to SEQ ID NO: 846442

SEQ ID NO: 846450 - protein, 189 aa, Homo sapiens
QKQGPFCENGQGPTLQLCGHFGFGIRCQSMGEKCMEWVIGRGLGPGGGRRSKQWPNQSVRVPTIPITAPMLDESVIIQLVEMGFPMDACRKAVYYTGNSGAEAAMNWVMSHMDDPGGWGGEQGGAGPPSSPKHINPFTSTDFANPLILPGSSGPGSTSAAADPPPEDCVTTIVSMGFSRDQALKALRAT

SEQ ID NO: 846451 - protein, 381 aa, Homo sapiens
MSRHEGVSCDACLKGNFRGRRYKCLICYDYDLCASCYESGATTTRHTTDHPMQCILTRVDFDLYYGGEAFSVEQPQSFTCPYCGKMGYTETSLQEHVTSEHAETSTEVICPICAALPGGDPNHVTDDFAAHLTLEHRAPRDLDESSGVRHVRRMFHPGRGLGGPRARRSNMHFTSSSTGGLSSSQSSYSPSNREAMDPIAELLSQLSGVRRSAGGQLNSSGPSASQLQQLQMQLQLERQHAQAARQQLETARNATRRTNTSSVTTTITQSTATTNIANTESSQQTLQNSQFLLTRLNDPKMSETERQSMESERADRSLFVQELLLSTLVREESSSSDEDDRGEMADFGAMGCVDIMPLDVALENLNLKESNKGNEPPPPPL

SEQ ID NO: 846452 - protein, 381 aa, Homo sapiens; identical to SEQ ID NO: 846451

SEQ ID NO: 846453 - protein, 211 aa, Homo sapiens
MHFTSSSTGGLSSSQSSYSPSNREAMDPIAELLSQLSGVRRSAGGQLNSSGPSASQLQQLQMQLQLERQHAQAARQQLETARNATRRTNTSSVTTTITQSTATTNIANTESSQQTLQNSQFLLTRLNDPKMSETERQSMESERADRSLFVQELLLSTLVREESSSSDEDDRGEMADFGAMGCVDIMPLDVALENLNLKESNKGNEPPPPPL

SEQ ID NO: 846454 - protein, 111 aa, Homo sapiens
MRSPVVAVLPHAAVLAAAASAVVVTEKRKGQRNEAVLLQNVSLLITEKKLSYRIHGFPIAWRNVLCAVFANESGQQLSWVCLVIVISGLSLLLHCVHSKGREKIYMIIIST

SEQ ID NO: 846455 - protein, 171 aa, Homo sapiens
AGERRPPAEWARERRWGRVGARGTGLAAGRRPLISMRTKAAGCAERRPLQPRTEAAAAPAGRGVSCDACLKGNFRGRRYKCLICYDYDLCASCYESGATTTRHTTDHPMQCILTRVDFDLYYGGEAFSVEQPQSFTCPYCGKMGYTETSLQEHVTSEHAETSTEVVKLWGP

SEQ ID NO: 846456 - protein, 233 aa, Homo sapiens
MIYLNFELPVAPEIPSWVRRSNMHFTSSSTGGLSSSQSSYSPSNREAMDPIAELLSQLSGVRRSAGGQLNSSGPSASQLQQLQMQLQLERQHAQAARQQLETARNATRRTNTSSVTTTITQSTATTNIANTESSQQTLQNSQFLLTRLNDPKMSETERQSMESERADRSLFVQELLLSTLVREESSSSDEDDRGEMADFGAMGCVDIMPLDVALENLNLKESNKGNEPPPPPL

SEQ ID NO: 846457 - protein, 284 aa, Homo sapiens
MSRHEGVSCDACLKGNFRGRRYKCLICYDYDLCASCYESGATTTRHTTDHPMQCILTRVDFDLYYGGEAFSVEQPQSFTCPYCGKMGYSSYSPSNREAMDPIAELLSQLSGVRRSAGGQLNSSGPSASQLQQLQMQLQLERQHAQAARQQLETARNATRRTNTSSVTTTITQSTATTNIANTESSQQTLQNSQFLLTRLNDPKMSETERQSMESERADRSLFVQELLLSTLVREESSSSDEDDRGEMADFGAMGCVDIMPLDVALENLNLKESNKGNEPPPPPL

SEQ ID NO: 846458 - protein, 41 aa, Homo sapiens
MRPRHSRHSGASPDPPSKCVAQIPDPDVSTVAQAPASIPAR

SEQ ID NO: 846459 - protein, 866 aa, Homo sapiens
QNSSDHANEEWETASESSDFSERRERREGPGSEPDSQVDGGLSGASLGEKKELAKRSFSSQRPVVDRQSRKLEPGGFGEKPVRPGGGDTSPRYESQQNGTPLKVKRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEQGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLKMESARKAWENSPSLPEQSSPGGAGSGIQPPSSVGASSGVNYSSFGGVSMPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRPSSASPSGKPSGSAVNMGSVQGHYVQQAKQRVDEKPSLGAVKLQEAPSAASQMKRTGAIKPRAVKVEESKA

SEQ ID NO: 846460 - protein, 808 aa, Homo sapiens
QNSSDHANEEWETASESSDFSERRERREGPGSEPDSQVDGGLSGASLGEKKELAKRSFSSQRPVVDRQSRKLEPGGFGEKPVRPGGGDTSPRYESQQNGTPLKVKRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEQGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLKMESARKAWENSPSLPEQSSPGGAGSGIQPPSSVGASSGVNYSSFGGVSMPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRQNNEWMRNPAWEP

SEQ ID NO: 846461 - protein, 162 aa, Homo sapiens
MILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRQNNEWMRNPAWEP

SEQ ID NO: 846462 - protein, 122 aa, Homo sapiens
MCGRSLVRLGFLHSIIPPPDFIVAQQLTMPLPRYGSGQQPLILPQSIQLPPGQSLSVGAPRRIPPPGSQPPVLNTSREPSQMEMKGFHFADSKQNVPSGGPVPSPQTYRQNNEWMRNPAWEP

SEQ ID NO: 846463 - protein, 808 aa, Homo sapiens; identical to SEQ ID NO: 846460

SEQ ID NO: 846464 - protein, 203 aa, Homo sapiens
QFWLSVRLLGLLSGALHRVGPDPETASVAFCTAGQPCPSVQGLSLPLLRCVSLSSVLEVPGWSVTATPSPFCVLGCLRSVVVFHPRDPRTVPSERLWPQALPSLCLLHVLGFDSISVVTRCVFSTPAFGFFRPSSASPSGKPSGSAVNMGSVQGHYVQQAKQRVDEKPSLGAVKLQEAPSAASQMKRTGAIKPRAVKVEESKA

SEQ ID NO: 846465 - protein, 808 aa, Homo sapiens; identical to SEQ ID NO: 846460

SEQ ID NO: 846466 - protein, 866 aa, Homo sapiens; identical to SEQ ID NO: 846459

SEQ ID NO: 846467 - protein, 808 aa, Homo sapiens; identical to SEQ ID NO: 846460

SEQ ID NO: 846468 - protein, 132 aa, Homo sapiens
VSELVRLSVVSVIDAARWWCARSGALPAFRHILAPTDIGFLAGPCLNTLANRCAHIESGPRPGVYTRLRPWLFGPPPPGLCAQSSLAFCNLSFSFLPLPEPAAFSGPVSTSHTAHREHHLVMEGVDPCVVPK

SEQ ID NO: 846469 - protein, 866 aa, Homo sapiens; identical to SEQ ID NO: 846459

SEQ ID NO: 846470 - protein, 186 aa, Homo sapiens
RWMMMPSYMDPRITPTRTPVDFYPSALHPSGLMKPMMPQESLNGTGCRSEDQNCVPPLQERKVTPIDSPPVWSPEGYMALQSKGYPLPHPKSSDTLAMDMRVRNESSFSASLGRAGGVSAQRDLFEERGEEYLSAFDKKAQADFDSCISSQRIGQELLFPPQENVQDAVKMYPSGEPGIRPTVLAV

SEQ ID NO: 846471 - protein, 86 aa, Homo sapiens
PGLQEFGMAALVEPSPLPFGSPVPSSCRLPLKSSFVPFHFLQNKPGLEGLLEMAFEDQGYQDVCTLSCSVMNGKRRLPESQLSSEM

SEQ ID NO: 846472 - protein, 577 aa, Homo sapiens
QNSSDHANEEWETASESSDFSERRERREGPGSEPDSQVDGGLSGASLGEKKELAKRSFSSQRPVVDRQSRKLEPGGFGEKPVRPGGGDTSPRYESQQNGTPLKVKRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEQGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLKMESARKAWENSPSLPEQSSPGGAGSGIQPPSSVGASSGVNYSSFGGVSMPPMPVASVAPSASMPGISSPEQGLGVLLHLLSRKTD

SEQ ID NO: 846473 - protein, 234 aa, Homo sapiens
RWMMMPSYMDPRITPTRTPVDFYPSALHPSGLMKPMMPQESLNGTGCRSEDQNCVPPLQERKVTPIDSPPVWSPEGYMALQSKGYPLPHPKSSDTLAMDMRVRNESSFSASLGRAGGVSAQRDLFEERGEEYLSAFDKKAQADFDSCISSQRIGQELLFPPQENVQDAGAPGGHTQNLRCSPLEPDFVPDEKKPECGSWDVSHQPETADTAHGVERETPREGTAFNISSWDKNG

SEQ ID NO: 846474 - protein, 172 aa, Homo sapiens
QFWLSVRLLGLLSGALHRVGPDPETASVAFCTAGQPCPSVQGLSLPLLRCVSLSSVLEVPGWSVTATPSPFCVLGCLRSVVVFHPRDPRTVPSERLWPQALPSLCLLHVLGFDSISVVTRCVFSTPAFGFFRPSSASPSGKPSGSAVNMGSVQGHYVQQVEDGFPDPSALDT

SEQ ID NO: 846475 - protein, 828 aa, Homo sapiens
QNSSDHANEEWETASESSDFSERRERREGPGSEPDSQVDGGLSGASLGEKKELAKRSFSSQRPVVDRQSRKLEPGGFGEKPVRPGGGDTSPRYESQQNGTPLKVKRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEQGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLKMESARKAWENSPSLPEQSSPGGAGSGIQPPSSVGASSGVNYSSFGGVSMPPMPVASVAPSASMPGSHLPPLYLDGHVFASQPRLVPQTIPQQQSYQQDPSDEEKKGLNSQAWMHLKEAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRQNNEWMRNPAWEP

SEQ ID NO: 846476 - protein, 234 aa, Homo sapiens
LLGRGGLLVTLLLRYRLRNQPGLTCKHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRQNNEWMRNPAWEP

SEQ ID NO: 846477 - protein, 866 aa, Homo sapiens; identical to SEQ ID NO: 846459

SEQ ID NO: 846478 - protein, 866 aa, Homo sapiens; identical to SEQ ID NO: 846459

SEQ ID NO: 846479 - protein, 866 aa, Homo sapiens; identical to SEQ ID NO: 846459

SEQ ID NO: 846480 - protein, 808 aa, Homo sapiens; identical to SEQ ID NO: 846460

SEQ ID NO: 846481 - protein, 866 aa, Homo sapiens; identical to SEQ ID NO: 846459

SEQ ID NO: 846482 - protein, 808 aa, Homo sapiens; identical to SEQ ID NO: 846460

SEQ ID NO: 846483 - protein, 852 aa, Homo sapiens
QNSSDHANEEWETASESSDFSERRERREGPGSEPDSQVDGGLSGASLGEKKELAKRSFSSQRPVVDRQSRKLEPGGFGEKPVRPGGGDTSPRYESQQNGTPLKVKRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEQGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLKMESARKAWENSPSLPEQSSPGGAGSGIQPPSSVGASSGVNYSSFGGVSMPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYREQRLGYEGLLGNGLSKTKASQACASHSCRAPADRLGQPLSFPVKRPDTPPSPDRHRN

SEQ ID NO: 846484 - protein, 148 aa, Homo sapiens
RWMMMPSYMDPRITPTRTPVDFYPSALHPSGLMKPMMPQESLNGTGCRSEDQNCVPPLQERKVTPIDSPPVWSPEGYMALQSKGYPLPHPKSSDTLAMDMRVRNESSFSASLGRAGGVSAQRDLFEERGEEYLSAFDKKAQAERWLEV

SEQ ID NO: 846485 - protein, 213 aa, Homo sapiens
LQDPVMYPQHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQRSGDYGRYHLHPAFQGLFKP

SEQ ID NO: 846486 - protein, 347 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 846487 - protein, 174 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYVYLMNKGSVVIFLMFLTLCQEIQKWQ

SEQ ID NO: 846488 - protein, 347 aa, Homo sapiens; identical to SEQ ID NO: 846486

SEQ ID NO: 846489 - protein, 347 aa, Homo sapiens; identical to SEQ ID NO: 846486

SEQ ID NO: 846490 - protein, 347 aa, Homo sapiens; identical to SEQ ID NO: 846486

SEQ ID NO: 846491 - protein, 145 aa, Homo sapiens
MYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMRKWCLWHTILFPKREFIK

SEQ ID NO: 846492 - protein, 228 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANLILELMAEPQEKQM

SEQ ID NO: 846493 - protein, 174 aa, Homo sapiens; identical to SEQ ID NO: 846487

SEQ ID NO: 846494 - protein, 315 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMHNQGGYGSVGRMGMGNNYSGGYGTPDGLGGYGRGGGGSGGYYGQGGMSGGGWRGMY

SEQ ID NO: 846495 - protein, 323 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYG

SEQ ID NO: 846496 - protein, 347 aa, Homo sapiens; identical to SEQ ID NO: 846486

SEQ ID NO: 846497 - protein, 277 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMRKWCLWHTILFPKREFIK

SEQ ID NO: 846498 - protein, 336 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYDSGGDSGGVGYRAK

SEQ ID NO: 846499 - protein, 311 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYDQLTKGDDTDPQSH

SEQ ID NO: 846500 - protein, 154 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREVMEVLMTMVAIIITAMGMMALMTE

SEQ ID NO: 846501 - protein, 298 aa, Homo sapiens
MDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 846502 - protein, 347 aa, Homo sapiens; identical to SEQ ID NO: 846486

SEQ ID NO: 846503 - protein, 154 aa, Homo sapiens; identical to SEQ ID NO: 846500

SEQ ID NO: 846504 - protein, 220 aa, Homo sapiens
GRSLQRLQEEGVLSELGSGSYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 846505 - protein, 347 aa, Homo sapiens; identical to SEQ ID NO: 846486

SEQ ID NO: 846506 - protein, 347 aa, Homo sapiens; identical to SEQ ID NO: 846486

SEQ ID NO: 846507 - protein, 306 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMGYVKFLKYAGLAAYR

SEQ ID NO: 846508 - protein, 266 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGPWWWRQWRLLWARRHEWRWMAWDVLKAKTPTYKS

SEQ ID NO: 846509 - protein, 338 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMGRRCGVGAAGAACSRGVFDAWADAGLGSSSFTFPEPDFLSQVRASVD

SEQ ID NO: 846510 - protein, 280 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGREGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQRSGDYGRYHLHPAFQGLFKP

SEQ ID NO: 846511 - protein, 154 aa, Homo sapiens; identical to SEQ ID NO: 846500

SEQ ID NO: 846512 - protein, 620 aa, Homo sapiens
MNLERLRKRVRQYLDQQQYQSALFWADKVASLSREEPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 846513 - protein, 620 aa, Homo sapiens; identical to SEQ ID NO: 846512

SEQ ID NO: 846514 - protein, 569 aa, Homo sapiens
MNLERLRKRVRQYLDQQQYQSALFWADKVASLSREEPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 846515 - protein, 459 aa, Homo sapiens
MNLERLRKRVRQYLDQQQYQSALFWADKVASLSREEPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLK

SEQ ID NO: 846516 - protein, 526 aa, Homo sapiens
MEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 846517 - protein, 363 aa, Homo sapiens
MEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 846518 - protein, 539 aa, Homo sapiens
MNLERLRKRVRQYLDQQQYQSALFWADKVASLSREEPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIAPNWK

SEQ ID NO: 846519 - protein, 511 aa, Homo sapiens
MNLERLRKRVRQYLDQQQYQSALFWADKVASLSREEPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTEQTLKTN

SEQ ID NO: 846520 - protein, 620 aa, Homo sapiens; identical to SEQ ID NO: 846512

SEQ ID NO: 846521 - protein, 620 aa, Homo sapiens; identical to SEQ ID NO: 846512

SEQ ID NO: 846522 - protein, 191 aa, Homo sapiens
MNLERLRKRVRQYLDQQQYQSALFWADKVASLSREEPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEGLETQAFLFYV

SEQ ID NO: 846523 - protein, 620 aa, Homo sapiens; identical to SEQ ID NO: 846512

SEQ ID NO: 846524 - protein, 526 aa, Homo sapiens; identical to SEQ ID NO: 846516

SEQ ID NO: 846525 - protein, 441 aa, Homo sapiens
MNLERLRKRVRQYLDQQQYQSALFWADKVASLSREEPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEKVC

SEQ ID NO: 846526 - protein, 372 aa, Homo sapiens [sequence omitted]

SEQ ID NO: 846527 - protein, 447 aa, Homo sapiens
EEKKTQQFLFFITQLAKGKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 846528 - protein, 526 aa, Homo sapiens; identical to SEQ ID NO: 846516

SEQ ID NO: 846529 - protein, 216 aa, Homo sapiens
MHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 846530 - protein, 538 aa, Homo sapiens
MNLERLRKRVRQYLDQQQYQSALFWADKVASLSREEPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGNLK

SEQ ID NO: 846531 - protein, 339 aa, Homo sapiens
MNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLYAHLACAFLWVVVAVAMAPLLVSPQTVQTNHTVVCLQLYREKASHHALVSLAVAFTFPFITTVTCYLLIIRSLRQGLRVEKRLKTKAVRMIAIVLAIFLVCFVPYHVNRSVYVLHYRSHGASCATQRILALANRITSCLTSLNGALDPIMYFFVAEKFRHALCNLLCGKRLKGPPPSFEGKTNESSLSAKSEL

SEQ ID NO: 846532 - protein, 339 aa, Homo sapiens; identical to SEQ ID NO: 846531

SEQ ID NO: 846533 - protein, 339 aa, Homo sapiens; identical to SEQ ID NO: 846531

SEQ ID NO: 846534 - protein, 339 aa, Homo sapiens; identical to SEQ ID NO: 846531

SEQ ID NO: 846535 - protein, 110 aa, Homo sapiens
MGSTQEGWQVCREGLWPSPLWPNTATSPAGILHKAQVSQLHITQLAAEAARVPVVVHGLDDAANDELTWKKTGPCWLGSTCLSPLRTLPSPVHLALRLLSAWPMGSLVGW

SEQ ID NO: 846536 - protein, 148 aa, Homo sapiens
MNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLSA

SEQ ID NO: 846537 - protein, 339 aa, Homo sapiens; identical to SEQ ID NO: 846531

SEQ ID NO: 846538 - protein, 367 aa, Homo sapiens
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLYAHLACAFLWVVVAVAMAPLLVSPQTVQTNHTVVCLQLYREKASHHALVSLAVAFTFPFITTVTCYLLIIRSLRQGLRVEKRLKTKAVRMIAIVLAIFLVCFVPYHVNRSVYVLHYRSHGASCATQRILALANRITSCLTSLNGALDPIMYFFVAEKFRHALCNLLCGKRLKGPPPSFEGKTNESSLSAKSEL

SEQ ID NO: 846539 - protein, 339 aa, Homo sapiens; identical to SEQ ID NO: 846531

SEQ ID NO: 846540 - protein, 148 aa, Homo sapiens; identical to SEQ ID NO: 846536

SEQ ID NO: 846541 - protein, 69 aa, Homo sapiens
GQKDQNCILRFEFLSQVMSSSSLAGLFLGASGVKESRFIKNHQLQIIWMETLPNHRDVCYHPHTKQLGN

SEQ ID NO: 846542 - protein, 69 aa, Homo sapiens; identical to SEQ ID NO: 846541

SEQ ID NO: 846543 - protein, 162 aa, Homo sapiens
MATERSRSAMDSPVPASMFAPEPSSPGAARAAAAAARLHGGFDSDCSEDGEALNGEPELDLTSKLVLVSPTSEQYDSLLRQMWERMDEGCGETIYVIGQGSDGTEYGLSEADMEASYATVKSMAEQIEADVILLRERQEAGGRVRDYLVRKRVGDNDFLEVR

SEQ ID NO: 846544 - protein, 669 aa, Homo sapiens
MATERSRSAMDSPVPASMFAPEPSSPGAARAAAAAARLHGGFDSDCSEDGEALNGEPELDLTSKLVLVSPTSEQYDSLLRQMWERMDEGCGETIYVIGQGSDGTEYGLSEADMEASYATVKSMAEQIEADVILLRERQEAGGRVRDYLVRKRVGDNDFLEVRVAVVGNVDAGKSTLLGVLTHGELDNGRGFARQKLFRHKHEIESGRTSSVGNDILGFDSEGNVVNKPDSHGGSLEWTKICEKSTKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNFSSERMCPIFQISNVTGENLDLLKMFLNLLSPRTSYREEEPAEFQIDDTYSVPGVGTVVSGTTLRGLIKLNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLQTTNNSPMNSKPQQIKMQSTKKGPLTKRDEGGPSGGPAVGAPPPGDEASSVGAGQPAASSNLQPQPKPSSGGRRRGGQRHKVKSQGACVTPASGC

SEQ ID NO: 846545 - protein, 557 aa, Homo sapiens
MEASYATVKSMAEQIEADVILLRERQEAGGRVRDYLVRKRVGDNDFLEVRVAVVGNVDAGKSTLLGVLTHGELDNGRGFARQKLFRHKHEIESGRTSSVGNDILGFDSEGNVVNKPDSHGGSLEWTKICEKSTKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNFSSERMCPIFQISNVTGENLDLLKMFLNLLSPRTSYREEEPAEFQIDDTYSVPGVGTVVSGTTLRGLIKLNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLQTTNNSPMNSKPQQIKMQSTKKGPLTKRDEGGPSGGPAVGAPPPGDEASSVGAGQPAASSNLQPQPKPSSGGRRRGGQRHKVKSQGACVTPASGC

SEQ ID NO: 846546 - protein, 505 aa, Homo sapiens
GQGWIMHETRFWGFCRLECWPVGVGSGRRILLLAALVKSWSGRTSSVGNDILGFDSEGNVVNKPDSHGGSLEWTKICEKSTKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNFSSERMCPIFQISNVTGENLDLLKMFLNLLSPRTSYREEEPAEFQIDDTYSVPGVGTVVSGTTLRGLIKLNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLQTTNNSPMNSKPQQIKMQSTKKGPLTKRDEGGPSGGPAVGAPPPGDEASSVGAGQPAASSNLQPQPKPSSGGRRRGGQRHKVKSQGACVTPASGC

SEQ ID NO: 846547 - protein, 671 aa, Homo sapiens
MATERSRSAMDSPVPASMFAPEPSSPGAARAAAAAARLHGGFDSDCSEDGEALNGEPELDLTSKLVLVSPTSEQYDSLLRQMWERMDEGCGETIYVIGQGSDGTEYGLSEADMEASYATVKSMAEQIEADVILLRERQEAGGRVRDYLVRKRVGDNDFLEVRVAVVGNVDAGKSTLLGVLTHGELDNGRGFARQKLFRHKHEIESGRTSSVGNDILGFDSEGNVVNKPDSHGGSLEWTKICEKSTKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNFSSERMCPIFQISNVTGENLDLLKMFLNLLSPRTSYREEEPAEFQIDDTYSVPGVGTVVSGTTLRGLIKLNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLLADCWSPLLPSFQLFLVTTYPWPWTDQTSIQNKSLFQVDSVVLPAQPLQVEVLPRERSCSACPGAPGDSWEQGSAVRSPAFPVRQAWLPCSGSLTSW

SEQ ID NO: 846548 - protein, 669 aa, Homo sapiens; identical to SEQ ID NO: 846544

SEQ ID NO: 846549 - protein, 669 aa, Homo sapiens; identical to SEQ ID NO: 846544

SEQ ID NO: 846550 - protein, 638 aa, Homo sapiens
MLCLMERSVALSCFNLVCAQVFSQVERTPVPLQCWGRGVVAFVRWGSWLAGWQAGWSGLPLLLMSGLLSPDGTEYGLSEADMEASYATVKSMAEQIEADVILLRERQEAGGRVRDYLVRKRVGDNDFLEVRVAVVGNVDAGKSTLLGVLTHGELDNGRGFARQKLFRHKHEIESGRTSSVGNDILGFDSEGNVVNKPDSHGGSLEWTKICEKSTKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNFSSERMCPIFQISNVTGENLDLLKMFLNLLSPRTSYREEEPAEFQIDDTYSVPGVGTVVSGTTLRGLIKLNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLQTTNNSPMNSKPQQIKMQSTKKGPLTKRDEGGPSGGPAVGAPPPGDEASSVGAGQPAASSNLQPQPKPSSGGRRRGGQRHKVKSQGACVTPASGC

SEQ ID NO: 846551 - protein, 372 aa, Homo sapiens
TLSVGAGNQLRQQSPASASALQETLKLLQRLLKSPGCRKIPVLVQSKDDVIVTASNFSSERMCPIFQISNVTGENLDLLKMFLNLLSPRTSYREEEPAEFQIDDTYSVPGVGTVVSGTTLRGLIKLNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLQTTNNSPMNSKPQQIKMQSTKKGPLTKRDEGGPSGGPAVGAPPPGDEASSVGAGQPAASSNLQPQPKPSSGGRRRGGQRHKVKSQGACVTPASGC

SEQ ID NO: 846552 - protein, 112 aa, Homo sapiens
LRQRAGPGKRRIVSKGKPTSCLGIIGLSPSRALTLTLATNPKTAGGFPLGDNPAFAWAGPGCPQLSLICPAWSLPSPRFLLGLRHWLPEGGLGLLRIMFCSTSCWRGGGMFP

SEQ ID NO: 846553 - protein, 235 aa, Homo sapiens
MEQDDPVEALTELRERRLGALELLQAAAGSGLAAYAVWALLLQPGFRRVPLRLQVPYVGASARQVEHVLSLLRGRPGKTVDLGSGDGRIVLAAHRCGLRPAVGYELNPWLVALARLHAWRAGCAGSVCYRRKDLWKVSLRDCRNVSVFLAPSVLPLLEDKLRTELPAGARVVSGRFPLPTWQPVTAVGEGLDRVWAYDVPEGGQAGEAASSRIPIQAAPGPSSAPIPGGLISQAS

SEQ ID NO: 846554 - protein, 289 aa, Homo sapiens
MEQDDPVEALTELRERRLGALELLQAAAGSGLAAYAVWALLLQPGFRRVPLRLQVRGGARPGRGARLPLRVSRSGRGRGELRPAVWSVRAGLRAGRERPVDSRRHPVQVPYVGASARQVEHVLSLLRGRPGKTVDLGSGDGRIVLAAHRCGLRPAVGYELNPWLVALARLHAWRAGCAGSVCYRRKDLWKVSLRDCRNVSVFLAPSVLPLLEDKLRTELPAGARVVSGRFPLPTWQPVTAVGEGLDRVWAYDVPEGGQAGEAASSRIPIQAAPGPSSAPIPGGLISQAS

SEQ ID NO: 846555 - protein, 174 aa, Homo sapiens
MEQDDPVEALTELRERRLGALELLQAAAGSGLAAYAVWALLLQPGFRRVPLRLQVPYVGASARQVEHVLSLLRGRPGKTVDLGSGDGRIVLAAHRCGLRPAVGYELNPWLVALARLHAWRAGCAGSVCYRRKDLWKVSLRDCRNVSVFLAPSVVGAGLPAPLGSPSHTPGCLLL

SEQ ID NO: 846556 - protein, 199 aa, Homo sapiens
MEQDDPVEALTELRERRLGALELLQAAAGSGLAAYAVWALLLQPGFRRVPLRLQVRGGARPGRGARLPLRVSRSGRGRGELRPAVVVVRAGLRAGRERPVDSRRHPVQVPYVGASARQVEHVLSLLRGRPGKTVDLGSGDGRIVLAAHRCGLRPAVGYELNPWLVALARLHAWRAGCAGSVCYRRKDLWKVTWGSLATR

SEQ ID NO: 846557 - protein, 230 aa, Homo sapiens
MEQDDPVEALTELRERRLGALELLQAAAGSGLAAYAVWALLLQPGFRRVPLRLQVRGGARPGRGARLPLRVSRSGRGRGELRPAVVVVRAGLRAGRERPVDSRRHPVQVPYVGASARQVEHVLSLLRGRPGKTVDLGSGDGRIVSACVWVFAAPPPPTCWRAPLPTSWFPHSRCPQVLAAHRCGLRPAVGYELNPWLVALARLHAWRAGCAGSVCYRRKDLWKVTWGSLA

SEQ ID NO: 846558 - protein, 218 aa, Homo sapiens
MEQDDPVEALTELRERRLGALELLQAAAGSGLAAYAVWALLLQPGFRRVPLRLQVPYVGASARQVEHVLSLLRGRPGKTVDLGSGDGRIVLAAHRCGLRPAVGYELNPWLVALARLHAWRAGCAGSVCYRRKDLWKLPLLEDKLRTELPAGARVVSGRFPLPTWQPVTAVGEGLDRVWAYDVPEGGQAGEAASSRIPIQAAPGPSSAPIPGGLISQAS

SEQ ID NO: 846559 - protein, 145 aa, Homo sapiens [sequence omitted]

SEQ ID NO: 846560 - protein, 145 aa, Homo sapiens [sequence omitted]

SEQ ID NO: 846561 - protein, 320 aa, Homo sapiens
SITGPVACIGAWHPARVAFSVARAGQKGYHHRTEINKKIYKIGQGYLIKDGKLIKNNASTVNELMAVMSHRKVLAFADMGPSGFLPRKRRQEAVGGKVKSVSAKDDAMPLRVSTSQPSWDDKAGMIHIVRGKLDRPGSKVNKKEVVEAVTCWVERTTMDGWWGWMGVCGKATRLAVRRLVEDLSYKVMYISDECKRRFYKTLDKSKKKGLTKVLEEMEDEDGKKQLGKDFSEACKKYAQVIRVMAHNQMCGPPGAKEGHLMEIPGTEAGAENGRAGELSRGPGPRWRERRRPGARAGPRGHGAKRAQHRARGWGTRPARE

SEQ ID NO: 846562 - protein, 130 aa, Homo sapiens
MPAAALPRQEAEGPMSGSGELSVRHHAIKFSVARAGQKGYHHRTEINKKIYKIGQGYLIKDGKLIKNNASTDYDLSDKSINPLGGFVHYGEVTNDFVMLKGCVVGTKKRVLTLRKSLLVQTKPPRGLMLL

SEQ ID NO: 846563 - protein, 169 aa, Homo sapiens
MPAAALPRQEAEGPMSGSGELSVRHHAIKFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 846564 - protein, 158 aa, Homo sapiens
SITGPVACIGAWHPARVAFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 846565 - protein, 169 aa, Homo sapiens; identical to SEQ ID NO: 846563

SEQ ID NO: 846566 - protein, 129 aa, Homo sapiens
MPAAALPRQEAEGPMSGSGELSVRHHAIKFSVARAGQKGYHHRTEINKKIYKIGQGYLIKDGKLIKNNASTDYDLSDKSINPLGGFVHYGEVTNDFVMLKGCVVGTKKRVQVWDFQVQVWDYQVQVWDY

SEQ ID NO: 846567 - protein, 158 aa, Homo sapiens
SQTWVPRLPSEASRHRGKVKSFPKDDPSKPVHLTAFLGYKAGMTHIVREVTGLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 846568 - protein, 183 aa, Homo sapiens
RGGAGVTTGVEGEARVPRSPGRPTAASEPRGERAALGAGAGVRPGSVPAHRVRAAERARLVSPGRAQEPDLGFAGWGAGLGGSGQAPPPLTPAPPADPRVAAGRVAQPWRPPPPHLHLHTLRRKPWSQVDRGMPCSAPSPPGLHPAMRASALLLMPFLQRRHRVPHAPAQAWFRLHGEEVKGS

SEQ ID NO: 846569 - protein, 344 aa, Homo sapiens
RGGAGVTTGVEGEARVPRSPGRPTAASEPRGERAALGAGAGVRPGSVPAHRVRAAERARLVSPGRAQEPDLGFAGWGAGLGGSGQAPPPLTPAPPADPRVAAGRVAQPWRPPPPHLHLRPAPCAPGQRLLPASLMALPQMCDGSHLASTLRYCMTVSGTVVLVAGTLCFAWWSEGDATAQPGQLAPPTEYPVPEGPSPLLRSVSFVCCGAGGLLLLIGLLWSVKASIPGPPRWDPYHLSRDLYYLTVESSEKESCRTPKVVDIPTYEEAVSFPVAEGPPTPPAYPTEEALEPSGSRDALLSTQPAWPPPSYESISLALDAVSAETTPSATRSCSGLVQTARGGS

SEQ ID NO: 846570 - protein, 119 aa, Homo sapiens
LLKLAKWFLDTNKSWKLKACSDFFFNPPRYRTPKVVDIPTYEEAVSFPVAEGPPTPPAYPTEEALEPSGSRDALLSTQPAWPPPSYESISLALDAVSAETTPSATRSCSGLVQTARGGS

SEQ ID NO: 846571 - protein, 118 aa, Homo sapiens [sequence omitted]

SEQ ID NO: 846572 - protein, 212 aa, Homo sapiens
MKRQLRRLRELHLYSTWKKYQEAMKTSLGVPQRERDEGSLGKPLCPPEILSETLPGSVKKRVCFPSEDHLEEFIAEHLPEASNQSLLTVAHADAGTQTNGDLEDLEEHGPGQTVSEEATEVHMMLTGDPDTLRELLIRACTLSELSKTQPANRATDPTRERGRTILSGTYNNVGEPRTEPEKEHVAKAKTEIKTKRTGGTPVERGTQAERKE

SEQ ID NO: 846573 - protein, 144 aa, Homo sapiens
MVDKDTERDIEMKRQLRRLRELHLYSTWKKYQEAMKTSLGVPQRGDLEDLEEHVPGQTVSEEATGVHMMQVDPATLAKKLEDSTITGSHQQMSASPSSAPAEEATEKTKVEEEVKTRKPKKKTRKPSKKSRWNVLKCWDIFNIF

SEQ ID NO: 846574 - protein, 144 aa, Homo sapiens; identical to SEQ ID NO: 846573

SEQ ID NO: 846575 - protein, 144 aa, Homo sapiens; identical to SEQ ID NO: 846573

SEQ ID NO: 846576 - protein, 342 aa, Homo sapiens
MELKKKILKTYNPDYDEDLVQEASSEDVLGVHMVDKDTERDIEMKRQLRRLRELHLYSTWKKYQEAMKTSLGVPQRERDEGSLGKPLCPPEILSETLPGSVKKRVCFPSEDHLEEFIAEHLPEASNQSLLTVAHADAGTQTNGDLEDLEEHGPGQTVSEEATEVHMMEGDPDTLAELLIRDVLQELSSYNGEEEDPEEVKTSLGVPQRGDLEDLEEHVPGQTVSEEATGVHMMQVDPATLAKSDLEDLEEHVPEQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 846577 - protein, 387 aa, Homo sapiens
MGCAYSCCLEVCCGEDEIVYPRMPGESTVCHREREKPITYHWYHWHPGHIYPRIASMEDYDEDLVQEASSEDVLGVHMVDKDTERDIEMKRQLRRLRELHLYSTWKKYQEAMKTSLGVPQRERDEGSLGKPLCPPEILSETLPGSVKKRVCFPSEDHLEEFIAEHLPEASNQSLLTVAHADAGTQTNGDLEDLEEHGPGQTVSEEATEVHMMEGDPDTLAELLIRDVLQELSSYNGEEEDPEEVKTSLGVPQRGDLEDLEEHVPGQTVSEEATGVHMMQVDPATLAKSDLEDLEEHVPEQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 846578 - protein, 144 aa, Homo sapiens; identical to SEQ ID NO: 846573

SEQ ID NO: 846579 - protein, 144 aa, Homo sapiens; identical to SEQ ID NO: 846573

SEQ ID NO: 846580 - protein, 113 aa, Homo sapiens
MASTLTNCVSTGIFLKRNSFFLRRIWNCQRKTIENVAQKSCAFPGMSSRYRGHCLNHCLPSGFLTSTSEDLCTQETAWSDPHSVFFFSRCRWTQPHWQSVRILGSSLCLGVKS

SEQ ID NO: 846581 - protein, 326 aa, Homo sapiens
MEKDGLCRADQQYECVAEIGEGAYGKVFKARDLKNGGRFVALKRVRVQTGEEGMPLSTIREVAVLRHLETFEHPNVVRLFDVCTVSRTDRETKLTLVFEHVDQDLTTYLDKVPEPGVPTETIKDMMFQLLRGLDFLHSHRVVHRDLKPQNILVTSSGQIKLADFGLARIYSFQMALTSVVVTLWYRAPEVLLQSSYATPVDLWSVGCIFAEMFRRKPLFRGSSDVDQLGKILDVIGLPGEEDWPRDVALPRQAFHSKSAQPIEKFVTDIDELGKDLLLKCLTFNPAKRISAYSALSHPYFQDLERCKENLDSHLPPSQNTSELNTA

SEQ ID NO: 846582 - protein, 326 aa, Homo sapiens; identical to SEQ ID NO: 846581

SEQ ID NO: 846583 - protein, 124 aa, Homo sapiens
MEKDGLCRADQQYECVAEIGEGAYGKVFKARDLKNGGRFVALKRVRVQTGEEGMPLSTIREVAVLRHLETFEHPNVVRLSQGAAPSPSGASRARGGPSRESSGPERCGAEGDWGGPARPVGLTE

SEQ ID NO: 846584 - protein, 326 aa, Homo sapiens; identical to SEQ ID NO: 846581

SEQ ID NO: 846585 - protein, 216 aa, Homo sapiens
MEKDGLCRADQQYECVAEIGEGAYGKVFKARDLKNGGRFVALKRVRVQTGEEGMPLSTIREVAVLRHLETFEHPNVVRLFDVCTVSRTDRETKLTLVFEHVDQDLTTYLDKVPEPGVPTETIKDMMFQLLRGLDFLHSHRVVHRDLKPQNILVTSSGQIKLADFGLARIYSFQMALTSVVVTLWYRAPEVLLQSSYATPVDLWSVGCIFAEMFRRK

SEQ ID NO: 846586 - protein, 1077 aa, Homo sapiens
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDLSPDEAVRESSRIIKNNIFYVMEYRELFLALFRKFDERCQPRSFLRDLVETTHLFLKMLERFCRSRGNLVVQNKQKKKKEEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLRELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEEEDAVGKEPLKAAPKKRQLLDSDEEQEEDEGRNRAPELGAPGIQKKKRYQIEDDEDD

SEQ ID NO: 846587 - protein, 1208 aa, Homo sapiens
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDLSPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLRELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEEEDAVGKEPLKAAPKKRQLLDSDEEQEEDEGRNRAPELGAPGIQKKKRYQIEDDEDD

SEQ ID NO: 846588 - protein, 1157 aa, Homo sapiens
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDLSPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLRELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEGNSATA

SEQ ID NO: 846589 - protein, 1208 aa, Homo sapiens; identical to SEQ ID NO: 846587

SEQ ID NO: 846590 - protein, 1280 aa, Homo sapiens
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDLSPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLRELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILEQSDPSSAGMGSLPLKWSLGAVHLDSSCLRLFCPGPSERAGAGGCGGQERGDSTKFLVLPSFSFPQPPMNFEPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEEEDAVGKEPLKAAPKKRQLLDSDEEQEEDEGRNRAPELGAPGIQKKKRYQIEDDEDD

SEQ ID NO: 846591 - protein, 1209 aa, Homo sapiens
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDLSPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLRELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEEEDAVGKEPLKAAPKKRQLLDSDEEQEEDEGRNRGREFDGTFFFFSNPEDKLYHVLTP

SEQ ID NO: 846592 - protein, 558 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 846593 - protein, 269 aa, Homo sapiens
MSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 846594 - protein, 269 aa, Homo sapiens; identical to SEQ ID NO: 846593

SEQ ID NO: 846595 - protein, 290 aa, Homo sapiens
NVLSPNPGVIPKMLMYTCFSMMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 846596 - protein, 374 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLVLIHFYSIDTKYKYLKLWCSY

SEQ ID NO: 846597 - protein, 558 aa, Homo sapiens; identical to SEQ ID NO: 846592

SEQ ID NO: 846598 - protein, 288 aa, Homo sapiens
MGNCSSQGFGNVGLHSMRYLHRFGAKCIAVGESDGSIWNPDGIDPKELEDFKLVLIHFYSIDTKYKYLKLLVQLLIVIFNQWQQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 846599 - protein, 558 aa, Homo sapiens; identical to SEQ ID NO: 846592

SEQ ID NO: 846600 - protein, 558 aa, Homo sapiens; identical to SEQ ID NO: 846592

SEQ ID NO: 846601 - protein, 540 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERDRISGASEKDIVHSGLAYTMERSARQIMRTAMKYNLGLDLRTAAYVNAIEKVFKVYNEAGVTFT

SEQ ID NO: 846602 - protein, 558 aa, Homo sapiens; identical to SEQ ID NO: 846592

SEQ ID NO: 846603 - protein, 571 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYKLSVKVEITYTREPFWYFAFK

SEQ ID NO: 846604 - protein, 528 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISVSVVTPQLYFTHAPCSFLQTELVRWISSAA

SEQ ID NO: 846605 - protein, 346 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPASLTVG

SEQ ID NO: 846606 - protein, 333 aa, Homo sapiens
MSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 846607 - protein, 306 aa, Homo sapiens
MGEDWGPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 846608 - protein, 403 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKVTTL

SEQ ID NO: 846609 - protein, 512 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 846610 - protein, 558 aa, Homo sapiens; identical to SEQ ID NO: 846592

SEQ ID NO: 846611 - protein, 558 aa, Homo sapiens; identical to SEQ ID NO: 846592

SEQ ID NO: 846612 - protein, 558 aa, Homo sapiens; identical to SEQ ID NO: 846592

SEQ ID NO: 846613 - protein, 558 aa, Homo sapiens; identical to SEQ ID NO: 846592

SEQ ID NO: 846614 - protein, 448 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPGSFNLERLGGRWPSNSLLLEVG

SEQ ID NO: 846615 - protein, 322 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQVKTKTKKVSLITDRH

SEQ ID NO: 846616 - protein, 239 aa, Homo sapiens
MEKEKGNDDGIPDQENSLDFSEHFNQLELLETHGHLIPTGTQSLWVGNSDEDEEQDDKNEEWYRLQEKKMEKDPSRLLLWAAEKNRLTTVRRLLSEKATHVNTRDEDEYTPLHRAAYSGHLDIVQELIAQGADVHAVTVDGWTPLHSACKWNNTRVASFLLQHDADINAQTKGLLTPLHLAAGNRDSKDTLELLLMNRYVKPGLKNNLEETAFDIARRTSIYHYLFEIVEGCTNSSPQS

SEQ ID NO: 846617 - protein, 124 aa, Homo sapiens
GFRLGTCRNRRRMRFLNYPTAGLFEAPQSRPKAVFFSGRKGRIREKKTTRSELASENPQGRKPEFRGRERRPFLSRHFMDNVDASSPVRLSLATARSEGAGKVAARPRPHAGANPEQARRRTRK

SEQ ID NO: 846618 - protein, 124 aa, Homo sapiens; identical to SEQ ID NO: 846617

SEQ ID NO: 846619 - protein, 239 aa, Homo sapiens; identical to SEQ ID NO: 846616

SEQ ID NO: 846620 - protein, 198 aa, Homo sapiens [sequence omitted]

SEQ ID NO: 846621 - protein, 478 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 846622 - protein, 478 aa, Homo sapiens; identical to SEQ ID NO: 846621

SEQ ID NO: 846623 - protein, 463 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 846624 - protein, 463 aa, Homo sapiens; identical to SEQ ID NO: 846623

SEQ ID NO: 846625 - protein, 463 aa, Homo sapiens; identical to SEQ ID NO: 846623

SEQ ID NO: 846626 - protein, 463 aa, Homo sapiens; identical to SEQ ID NO: 846623

SEQ ID NO: 846627 - protein, 494 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 846628 - protein, 463 aa, Homo sapiens; identical to SEQ ID NO: 846623

SEQ ID NO: 846629 - protein, 494 aa, Homo sapiens; identical to SEQ ID NO: 846627

SEQ ID NO: 846630 - protein, 184 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPG

SEQ ID NO: 846631 - protein, 380 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQAQAAVQGPVGTDFKPLNSTPATTTEPPKPTFPAYTQSTASTTSTTNSTAAKPAASITSKPATLTTTSATSKLELEWKKGLPKFFLQTSCLQGFFERLKNFKSII

SEQ ID NO: 846632 - protein, 361 aa, Homo sapiens [sequence omitted]

SEQ ID NO: 846633 - protein, 380 aa, Homo sapiens
VAEMKLRLQSRHHHIHQNHLVASFFDFLVSSVQEGVRFASMSFSGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 846634 - protein, 294 aa, Homo sapiens
MMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 846635 - protein, 277 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQK

SEQ ID NO: 846636 - protein, 263 aa, Homo sapiens
YKACRNNQSSNFGPMKEEILEAAGMPPPVPRPGIPPMTQAQAVSAPGILNRPPAPTATVPAPQPPVTKPLFPSAGQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 846637 - protein, 218 aa, Homo sapiens [sequence omitted]

SEQ ID NO: 846638 - protein, 128 aa, Homo sapiens
MPLCLVSLCIRVFSPCAYFYSQEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 846639 - protein, 256 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGMMPMGGMMPPGPGIPPLMPGMPPGMPPPVPRPGIPPMTQAQGSAADLIDTDTEVSCQAQYSLSRGSQEAAGA

SEQ ID NO: 846640 - protein, 75 aa, Homo sapiens
ESKQCSESKQCPESKQCPESKQGSESKQCPESKQCPKSKQCSESKQCPESKQCPESKQCPPMGMRPPVMSQGGRY

SEQ ID NO: 846641 - protein, 463 aa, Homo sapiens; identical to SEQ ID NO: 846623

SEQ ID NO: 846642 - protein, 463 aa, Homo sapiens; identical to SEQ ID NO: 846623

SEQ ID NO: 846643 - protein, 463 aa, Homo sapiens; identical to SEQ ID NO: 846623

SEQ ID NO: 846644 - protein, 463 aa, Homo sapiens; identical to SEQ ID NO: 846623

SEQ ID NO: 846645 - protein, 494 aa, Homo sapiens; identical to SEQ ID NO: 846627

SEQ ID NO: 846646 - protein, 494 aa, Homo sapiens; identical to SEQ ID NO: 846627

SEQ ID NO: 846647 - protein, 494 aa, Homo sapiens; identical to SEQ ID NO: 846627

SEQ ID NO: 846648 - protein, 494 aa, Homo sapiens; identical to SEQ ID NO: 846627

SEQ ID NO: 846649 - protein, 395 aa, Homo sapiens
MGRKKKKQLKPWCWYCNRDFDDEKILIQHQKAKHFKCHICHKKLYTGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 846650 - protein, 331 aa, Homo sapiens
MPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 846651 - protein, 293 aa, Homo sapiens
MPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 846652 - protein, 142 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDNPQSLHSLLIHSLQLQQLVQQIVLQLNQRLQ

SEQ ID NO: 846653 - protein, 194 aa, Homo sapiens [sequence omitted]

SEQ ID NO: 846654 - protein, 287 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPWVDDATWTGYNSDAGCTRYAHCTVLDPPWSGKCQRRIYDTLQKRLPNSDKLSGDGLAHSSIRSFQVPKLRRRDTCANHVVAKRN

SEQ ID NO: 846655 - protein, 89 aa, Homo sapiens
VEHSYGSQEEEAAEAVVLVSFVGLKSRSRWGAGCWGLGLGGLDLAYGVERLYLGVCVGGLVAGIGLGKASRKMGFRGRQAFAVVGRVTL

SEQ ID NO: 846656 - protein, 157 aa, Homo sapiens
GRMEGPGMWASGHQWHHRRGATDILGTACPQVNTPAAEVLYTVIQDWAQLDAGSMVLDVCCGTGTIGLALARVSPPALLRAPSPHPKTPIDPSSKSPQLTPSCPRPSSSLLPTGPHVLPSLGGATPRFPVSEGKEGHWGRAMPRGCGGRPGERPGQW

SEQ ID NO: 846657 - protein, 687 aa, Homo sapiens
MSENLDNEGPKPMESCGQESSSALSCPTVSVPPAAPAALEEVEKEGAGAATGPGPQPGLYSYIRDDLFTSEIFKLELQNVPRHASFSDVRRFLGRFGLQPHKTKLFGQPPCAFVTFRSAAERDKALRVLHGALWKGRPLSVRLARPKADPMARRRRQEGESEPPVTRVADVVTPLWTVPYAEQLERKQLECEQVLQKLAKEIGSTNRALLPWLLEQRHKHNKACCPLEGVRPSPQQTEYRNKCEFLVGVGVDGEDNTVGCRLGKYKGGTCAVAAPFDTVHIPEATKQVVKAFQEFIRLRTCDGAPGKSYAVWEQRVVILPREFWSACHFSQMKEGVARGESRGTACPVVGTWASCDSHRSTPYSAYDPETYTGHWKQLTVRTSRRHQAMAIAYFHPQKLSPEELAELKTSLAQHFTAGPGRASGVTCLYFVEEGQRKTPSQEGLPLEHVAGDRCIHEDLLGLTFRISPHAFFQVNTPAAEVLYTVIQDWAQLDAGSMVLDVCCGTGTIGLALARKVKRVIGVELCPEAVEDARVNAQDNELSNVEFHCGRAEDLVPTLVSRLASQHLVAILDPPRAGLHSKVILAIRRAKNLRRLLYVSCNPRAAMGNFVDLCRAPSNRVKGIPFRPVKAVAVDLFPQTPHCEMLILFERVEHPNGTGVLGPHSPPAQPTPGPPDNTLQETGTFPSS

SEQ ID NO: 846658 - protein, 625 aa, Homo sapiens
MSENLDNEGPKPMESCGQESSSALSCPTVSVPPAAPAALEEVEKEGAGAATGPGPQPGLYSYIRDDLFTSEIFKLELQNVPRHASFSDVRRFLGRFGLQPHKTKLFGQPPCAFVTFRSAAERDKALRVLHGALWKGRPLSVRLARPKADPMARRRRQEGESEPPVTRVADVVTPLWTVPYAEQLERKQLECEQVLQKLAKEIGSTNRALLPWLLEQRHKHNKACCPLEGVRPSPQQTEYRNKCEFLVGVGVDGEDNTVGCRLGKYKGGTCAVAAPFDTVHIPEATKQVVKAFQEFIRSTPYSAYDPETYTGHWKQLTVRTSRRHQAMAIAYFHPQKLSPEELAELKTSLAQHFTAGPGRASGVTCLYFVEEGQRKTPSQEGLPLEHVAGDRCIHEDLLGLTFRISPHAFFQVNTPAAEVLYTVIQDWAQLDAGSMVLDVCCGTGTIGLALARKVKRVIGVELCPEAVEDARVNAQDNELSNVEFHCGRAEDLVPTLVSRLASQHLVAILDPPRAGLHSKVILAIRRAKNLRRLLYVSCNPRAAMGNFVDLCRAPSNRVKGIPFRPVKAVAVDLFPQTPHCEMLILFERVEHPNGTGVLGPHSPPAQPTPGPPDNTLQETGTFPSS

SEQ ID NO: 846659 - protein, 335 aa, Homo sapiens
MSENLDNEGPKPMESCGQESSSALSCPTVSVPPAAPAALEEVEKEGAGAATGPGPQPGLYSYIRDDLFTSEIFKLELQNVPRHASFSDVRRFLGRFGLQPHKTKLFGQPPCAFVTFRSAAERDKALRVLHGALWKGRPLSVRLARPKADPMARRRRQEGESEPPVTRVADVVTPLWTVPYAEQLERKQLECEQVLQKLAKEIGSTNRALLPWLLEQRHKHNKACCPLEGVRPSPQQTEYRNKCEFLVGVGVDGEDNTVGCRLGKYKGGTCAVAAPFDTVHIPEATKQVVKAFQEFIRSTPYSAYDPETYTGHWKQLTVRTSRRHQAWLAGQDIQR

SEQ ID NO: 846660 - protein, 177 aa, Homo sapiens
LWATKVQIFNDVHICPQSKKDARVNLRTIELSNVEFHCGRAEDLVPTLVSRLASQHLVAILDPPRAGLHSKVILAIRRAKNLRRLLYVSCNPRAAMGNFVDLCRAPSNRVKGIPFRPVKAVAVDLFPQTPHCEMLILFERVEHPNGTGVLGPHSPPAQPTPGPPDNTLQETGTFPSS

SEQ ID NO: 846661 - protein, 41 aa, Homo sapiens
MLILFERVEHPNGTGVLGPHSPPAQPTPGPPDNTLQETGTF

SEQ ID NO: 846662 - protein, 625 aa, Homo sapiens; identical to SEQ ID NO: 846658

SEQ ID NO: 846663 - protein, 625 aa, Homo sapiens; identical to SEQ ID NO: 846658

SEQ ID NO: 846664 - protein, 625 aa, Homo sapiens; identical to SEQ ID NO: 846658

SEQ ID NO: 846665 - protein, 477 aa, Homo sapiens
ARGWNTHADFADECPKPELLAIRFLDPGTVATCVGLQLHHRRDVVVGTDLQGLVPPHEEADGPFLLVLQELDVTSASLLPFWEIVLRGTEYRNKCEFLVGVGVDGEDNTVGCRLGKYKGGTCAVAAPFDTVHIPEATKQVVKAFQEFIRSTPYSAYDPETYTGHWKQLTVRTSRRHQAMAIAYFHPQKLSPEELAELKTSLAQHFTAGPGRASGVTCLYFVEEGQRKTPSQEGLPLEHVAGDRCIHEDLLGLTFRISPHAFFQVNTPAAEVLYTVIQDWAQLDAGSMVLDVCCGTGTIGLALARKVKRVIGVELCPEAVEDARVNAQDNELSNVEFHCGRAEDLVPTLVSRLASQHLVAILDPPRAGLHSKVILAIRRAKNLRRLLYVSCNPRAAMGNFVDLCRAPSNRVKGIPFRPVKAVAVDLFPQTPHCEMLILFERVEHPNGTGVLGPHSPPAQPTPGPPDNTLQETGTFPSS

SEQ ID NO: 846666 - protein, 207 aa, Homo sapiens
MSENLDNEGPKPMESCGQESSSALSCPTVSVPPAAPAALEEVDDKMCAAECAWWAYQCGRGLSPGLYSLNHPVGIELFGLPLRSLNLVRLCTENLVASAQPVPMGVFQWQTVPGLPLPIWGGPLAYFGGSVANVRPPKPIVERRKEASVLVVAKRHRPRQLTMAQFIWLDTEFFPSTIDQLWPRQRMGGTTNGAPLARQVFATWVAP

SEQ ID NO: 846667 - protein, 239 aa, Homo sapiens
MTTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPWVSEVNWRTKGPILAKTDAGLPFGFR

SEQ ID NO: 846668 - protein, 162 aa, Homo sapiens
RGKLLGQDSRMTTILTYPFKNLPTASKWALRFSIRPLSCSSQLRAAPAVQTKTKKTLAKPNIRNVVVVDGVRTPFLLSGTSYKYLIPHNLTISTLTTLLHQTSIPTKLLHYIILYTLIQQFYSYSHFHHNLYLLQPTITTIFTFITLPNVLHPSNSSLIYLP

SEQ ID NO: 846669 - protein, 474 aa, Homo sapiens
MTTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRILCVGLRIQDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 846670 - protein, 272 aa, Homo sapiens
MTTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPG

SEQ ID NO: 846671 - protein, 475 aa, Homo sapiens
MTTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 846672 - protein, 475 aa, Homo sapiens; identical to SEQ ID NO: 846671

SEQ ID NO: 846673 - protein, 474 aa, Homo sapiens; identical to SEQ ID NO: 846669

SEQ ID NO: 846674 - protein, 252 aa, Homo sapiens [sequence omitted]

SEQ ID NO: 846675 - protein, 252 aa, Homo sapiens [sequence omitted]

SEQ ID NO: 846676 - protein, 352 aa, Homo sapiens [sequence omitted]

SEQ ID NO: 846677 - protein, 452 aa, Homo sapiens
MTLVSGWLLYGWIIAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 846678 - protein, 460 aa, Homo sapiens [sequence omitted]

SEQ ID NO: 846679 - protein, 400 aa, Homo sapiens [sequence omitted]

SEQ ID NO: 846680 - protein, 475 aa, Homo sapiens; identical to SEQ ID NO: 846671

SEQ ID NO: 846681 - protein, 475 aa, Homo sapiens; identical to SEQ ID NO: 846671

SEQ ID NO: 846682 - protein, 454 aa, Homo sapiens
MTTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMATDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 846683 - protein, 475 aa, Homo sapiens; identical to SEQ ID NO: 846671

SEQ ID NO: 846684 - protein, 384 aa, Homo sapiens
MTTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYASPKEAIQPWFFYPCSFLQTNQNPWL

SEQ ID NO: 846685 - protein, 272 aa, Homo sapiens; identical to SEQ ID NO: 846670

SEQ ID NO: 846686 - protein, 252 aa, Homo sapiens [sequence omitted]

SEQ ID NO: 846687 - protein, 475 aa, Homo sapiens; identical to SEQ ID NO: 846671

SEQ ID NO: 846688 - protein, 452 aa, Homo sapiens; identical to SEQ ID NO: 846677

SEQ ID NO: 846689 - protein, 388 aa, Homo sapiens
MSIPDYILPEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 846690 - protein, 271 aa, Homo sapiens
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERALRDLEVQNAVLVSPSLSGHYALPFLMRGHHQLHGFVPIAPTSTQNYTQEQFWAVKTPTLILYGELDHILARESLRQLRHLPNHSVVKLRNAGHACYLHKPQDFHLVLLAFLDHLP

SEQ ID NO: 846691 - protein, 188 aa, Homo sapiens
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPDSNPYPVWRAGPHPGSRVTAAAPPPAQPLCGEATQCRPCLLPPQAARLPPCPACLP

SEQ ID NO: 846692 - protein, 124 aa, Homo sapiens
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRLQPLSCMESWTTSWLESHCGSSATCPTTLW

SEQ ID NO: 846693 - protein, 243 aa, Homo sapiens
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERALRDLEVQNAVLVSPSLSGHYALPFLMRGHHQLHGFVPIAPTSTQNYTQEQFWAVKVLGEGSQRSWHPVCGLGGFRTQVLLGGTWPYP

SEQ ID NO: 846694 - protein, 379 aa, Homo sapiens
PKPCPEACPLSTWQVNGHSPVASLGQPVQCTQVLPGLGGEANTMQQQYREASLPTAGQGLSEEEGLALHLDGALALLHACCHACCCCAGEGPVVQNHDDEGPQNTLPRVAVPEEQQGSLQEVSRTLRTCLGTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERALRDLEVQNAVLVSPSLSGHYALPFLMRGHHQLHGFVPIAPTSTQNYTQEQFWAVKTPTLILYGELDHILARESLRQLRHLPNHSVVKLRNAGHACYLHKPQDFHLVLLAFLDHLP

SEQ ID NO: 846695 - protein, 234 aa, Homo sapiens
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERALRDLEVQNYTQEQFWAVKTPTLILYGELDHILARESLRQLRHLPNHSVVKLRNAGHACYLHKPQDFHLVLLAFLDHLP

SEQ ID NO: 846696 - protein, 135 aa, Homo sapiens
PKPCPEACPLSTWQVNGHSPVASLGQPVQCTQVLPGLGGEANTMQQQYREASLPTAGQGLSEEEGLALHLDGALALLHACCHACCCCAGEGPVVQNHDDEGPQNTLPRVAVPEEQQGSLQEVSRTLRTCLGVRRT

SEQ ID NO: 846697 - protein, 266 aa, Homo sapiens
MVATPKEGTQGSEKGRLGTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERALRDLEVQNAVLVSPSLSGHYALPFLMRGHHQLHGFVPIAPTSTQNYTQEQFWAVKTPTLILYGELDHILARESLRQLRHLPNHSVVKLRNAGHACYLHKPQDFHLVLLAFLDHLP

SEQ ID NO: 846698 - protein, 139 aa, Homo sapiens
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPACPACLP

SEQ ID NO: 846699 - protein, 565 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846700 - protein, 144 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVCE

SEQ ID NO: 846701 - protein, 609 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSGSRPAPPAVWMSFVHRCQRSHHHPRSLRIRGHPLPPTPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846702 - protein, 609 aa, Homo sapiens; identical to SEQ ID NO: 846701

SEQ ID NO: 846703 - protein, 674 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGERGLGLLLIWTSILHSASWPCDLLLSASPPLRLHQGSAVHGLHDHHDQGAHLPTLCHPAHVPGHEVSPALSPDPPDLIRVPSPAFTDCPFRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846704 - protein, 549 aa, Homo sapiens
MGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSGSRPAPPAVWMSFVHRCQRSHHHPRSLRIRGHPLPPTPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846705 - protein, 594 aa, Homo sapiens
MFRTAVMMAASLALTGAVVAHAYYLKHQFYPTVVYLTKSSPSMAVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSGSRPAPPAVWMSFVHRCQRSHHHPRSLRIRGHPLPPTPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846706 - protein, 561 aa, Homo sapiens
MSAAPKVRAGLLGKNVWYPHYSLPGPQHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSGSRPAPPAVWMSFVHRCQRSHHHPRSLRIRGHPLPPTPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846707 - protein, 170 aa, Homo sapiens [sequence omitted]

SEQ ID NO: 846708 - protein, 609 aa, Homo sapiens; identical to SEQ ID NO: 846701

SEQ ID NO: 846709 - protein, 348 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPESRIAPSTRIAPSPECQDPLE

SEQ ID NO: 846710 - protein, 253 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMR

SEQ ID NO: 846711 - protein, 322 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTRWEGPWGAC

SEQ ID NO: 846712 - protein, 131 aa, Homo sapiens
MSAAPKVRAGCWERMFGIHIIPCLAPSTFWNVPGTPSQRLVWPSPFFGMTSAPALLHSSLFFSSSNVSTGWLRTVWTLWNAAPTSPGSFTAALSVSEIQGRGREDWNVNRGPVLQSTGYPPQLYRTDNLGS

SEQ ID NO: 846713 - protein, 646 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSGSRPAPPAVWMSFVHRCQRSHHHPRSLRIRGHPLPPTPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPGRCDWPPAGGAGNFSRFHFQSLCPQLLSQWAQRRCLRMESPMQQSSAGAACRSWSLLLPTDTAPAQPQPLLF

SEQ ID NO: 846714 - protein, 616 aa, Homo sapiens
ALQSTRSLSHSSVFPVLNFFPNGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSGSRPAPPAVWMSFVHRCQRSHHHPRSLRIRGHPLPPTPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846715 - protein, 478 aa, Homo sapiens
MTSAPALLHSSLFFSSSNVSTGWLRTVWTLWNAAPTSPGSFTAALSYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSGSRPAPPAVWMSFVHRCQRSHHHPRSLRIRGHPLPPTPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846716 - protein, 428 aa, Homo sapiens
MTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSGSRPAPPAVWMSFVHRCQRSHHHPRSLRIRGHPLPPTPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846717 - protein, 236 aa, Homo sapiens
MFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846718 - protein, 417 aa, Homo sapiens
MAFMKPVNRLCVEHVHSLFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 846719 - protein, 609 aa, Homo sapiens; identical to SEQ ID NO: 846701

SEQ ID NO: 846720 - protein, 609 aa, Homo sapiens; identical to SEQ ID NO: 846701

SEQ ID NO: 846721 - protein, 198 aa, Homo sapiens
MSSRGHSTLPRTLMAPRMISEGDIGGIAQITSSLFLGRGSVASNRHLLQARGITCIVNATIEIPNFNWPQFEYVKVPLADMPHAPIGLYFDTVADKIHSVSRKHGATLVHCAAGVSRSATLCIAYLMKFHNVCLLEAYNWVKARRPVIRPNVGFWRQLIDYERQLFGKSTVKMVQTPYGIVPDVYEKESRHLMPYWGI

SEQ ID NO: 846722 - protein, 124 aa, Homo sapiens
TKEAPSRQSAHFGSASWQNRVMVKSWVLEGARCDCVSVSQLCHLLELYRDLLNLSCLACKMEMKGMVSTPTGSNKLHLIHNEETETRRDTVLGQSAKLEHSLDFEPSLPAPSLPAALSLSTPKP

SEQ ID NO: 846723 - protein, 198 aa, Homo sapiens; identical to SEQ ID NO: 846721

SEQ ID NO: 846724 - protein, 198 aa, Homo sapiens; identical to SEQ ID NO: 846721

SEQ ID NO: 846725 - protein, 198 aa, Homo sapiens; identical to SEQ ID NO: 846721

SEQ ID NO: 846726 - protein, 198 aa, Homo sapiens; identical to SEQ ID NO: 846721

SEQ ID NO: 846727 - protein, 164 aa, Homo sapiens
MSSRGHSTLPRTLMAPRMISEGDIGGIAQITSSLFLGRGSVASNRHLLQARGITCIVNATIEIPNFNWPQFEYVKVPLADMPHAPIGLYFDTVADKIHSVSRKHGATLVHCAAGVSRSATLCIAYLMKFHNVCLLEAYNWVKAQRRLLEATDRLRAPALWEVDS

SEQ ID NO: 846728 - protein, 170 aa, Homo sapiens
MSSRGHSTLPRTLMAPRMISEGDIGGIAQITSSLFLGRGSVASNRHLLQARGITCIVNATIEIPNFNWPQFEYVKVPLADMPHAPIGLYFDTVADKIHSVSRKHGATLVHCAAGVSRSATLCIAYLMKFHNVCLLEAYNWVKARRPVIRPNVGFWRQLNILNAKYSGTRL

SEQ ID NO: 846729 - protein, 198 aa, Homo sapiens; identical to SEQ ID NO: 846721

SEQ ID NO: 846730 - protein, 108 aa, Homo sapiens
PRLEDQWRRHPRPRAARTAGSTVPGPPPAPLYRDLLNLSCLACKMEMKGMVSTPTGSNKLHLIHNEETETRRDTVLGQSAKLEHSLDFEPSLPAPSLPAALSLSTPKP

SEQ ID NO: 846731 - protein, 198 aa, Homo sapiens; identical to SEQ ID NO: 846721

SEQ ID NO: 846732 - protein, 198 aa, Homo sapiens; identical to SEQ ID NO: 846721

SEQ ID NO: 846733 - protein, 103 aa, Homo sapiens
MRGVAEENVLERLIYRERDGVGKSEERGELRVADMRGEERCEDERGLKRRVEWLSEYIVSSGLAAVVNARDIDRLVASTKGPRREKLKVERVESAQSLCRVVY

SEQ ID NO: 846734 - protein, 538 aa, Homo sapiens
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDVIRNFTLDMI

SEQ ID NO: 846735 - protein, 538 aa, Homo sapiens; identical to SEQ ID NO: 846734

SEQ ID NO: 846736 - protein, 263 aa, Homo sapiens
MPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDVIRNFTLDMI

SEQ ID NO: 846737 - protein, 246 aa, Homo sapiens
PSSENQEKQNPWQPTTFHEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDVIRNFTLDMI

SEQ ID NO: 846738 - protein, 277 aa, Homo sapiens
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVSELYVTACD

SEQ ID NO: 846739 - protein, 293 aa, Homo sapiens
EEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEVIRLSQFLLKGHRWDQVKKEDQEATGPRLSRELLAEKEPEVLQDSLDRCYSTPSVYLGLTDSCQPYRSAFYVLEQQRVGLAVDMDETPAAVGLLLLLWLSLPVRLPSFVVSQRCAGLLLAALRIQGVGCQVQVRTLREAGWEPFVRPQGRANSDQSSMSLTRIPGVEAGQTPRNYRSSPSRFRACPPWVTEPASR

SEQ ID NO: 846740 - protein, 538 aa, Homo sapiens; identical to SEQ ID NO: 846734

SEQ ID NO: 846741 - protein, 575 aa, Homo sapiens
EEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEVIRLSQFLLKGHRWDQVKKEDQEATGPRLSRELLAEKEPEVLQDSLDRCYSTPSVYLGLTDSCQPYRSAFYVLEQQRVGLAVDMDEDPGGSGAVAVAVAVAARQAAFFCRFPALRRTSPGGAADPGGRLPGTGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDVIRNFTLDMI

SEQ ID NO: 846742 - protein, 538 aa, Homo sapiens; identical to SEQ ID NO: 846734

SEQ ID NO: 846743 - protein, 263 aa, Homo sapiens; identical to SEQ ID NO: 846736

SEQ ID NO: 846744 - protein, 293 aa, Homo sapiens; identical to SEQ ID NO: 846739

SEQ ID NO: 846745 - protein, 78 aa, Homo sapiens
WFHHCRPDDRGMLDMCGFDTGALGEYRKKMDIPAKLIVCGMTSNGFTIADPDDRGMLDMCGFDTGALDVIRNFTLDMI

SEQ ID NO: 846746 - protein, 234 aa, Homo sapiens
EEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEVIRLSQFLLKGHRWDQVKKEDQEATGPRLSRELLAEKEPEVLQDSLDRCYSTPSVYLGLTDSCQPYRSAFYVLEQQRVGLAVDMDETPAAVGLLLLLWLSLPVRLPSFVVSQRCAGLLLAALRIQGVGCQVQDLQL

SEQ ID NO: 846747 - protein, 252 aa, Homo sapiens
MAAFGRQVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEGKLKRVLYCCPEIFTMRQQDINDTVRLLKEKCLFTVQQVTKILHSCPSVLREDLGQLEYKFQVRMTDSVISVVSGENDW

SEQ ID NO: 846748 - protein, 248 aa, Homo sapiens
MVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEGVERTLRGVLTVALNFTCARAYDLSGLKGRAFTGSSRRLAVPCSEDRPIQSCSPAGPPREVGPPIELAGPKRNTLANGGCN

SEQ ID NO: 846749 - protein, 381 aa, Homo sapiens
MAAFGRQVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEGKLKRVLYCCPEIFTMRQQDINDTVRLLKEKCLFTVQQVTKILHSCPSVLREDLGQLEYKFQYAYFRMGIKHPDIVKSEYLQYSLTKIKQRHIYLERLGRYQTPDKKGQTQIPNPLLKDILRVSEAEFLARTACTSVEEFQVFKKLLAREEEESESSTSDDKRASLDEDEDDDDEEDNDEDDNDEDDDDEDDDEAEDNDEDEDDDEEE

SEQ ID NO: 846750 - protein, 381 aa, Homo sapiens; identical to SEQ ID NO: 846749

SEQ ID NO: 846751 - protein, 394 aa, Homo sapiens
EKYVKKEERSGIPGCCVRPEVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEGKLKRVLYCCPEIFTMRQQDINDTVRLLKEKCLFTVQQVTKILHSCPSVLREDLGQLEYKFQYAYFRMGIKHPDIVKSEYLQYSLTKIKQRHIYLERLGRYQTPDKKGQTQIPNPLLKDILRVSEAEFLARTACTSVEEFQVFKKLLAREEEESESSTSDDKRASLDEDEDDDDEEDNDEDDNDEDDDDEDDDEAEDNDEDEDDDEEE

SEQ ID NO: 846752 - protein, 375 aa, Homo sapiens [sequence omitted]

SEQ ID NO: 846753 - protein, 381 aa, Homo sapiens; identical to SEQ ID NO: 846749

SEQ ID NO: 846754 - protein, 381 aa, Homo sapiens; identical to SEQ ID NO: 846749

SEQ ID NO: 846755 - protein, 95 aa, Homo sapiens
EGRGRTAASGAVTAAIFSALWLRSAVSSLVLQRDCKEKDFCFAKEKQLGDSVHIATVESDGSGSPLPVEGVPAKGRCRRTNLLLCNCQSCAFQLR

SEQ ID NO: 846756 - protein, 95 aa, Homo sapiens; identical to SEQ ID NO: 846755

SEQ ID NO: 846757 - protein, 220 aa, Homo sapiens
ARYELGLNRPRLCIFSALWLRSAVVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEEGTRSCRFWLGAVAHACNPRSLGGRGRQIT

SEQ ID NO: 846758 - protein, 381 aa, Homo sapiens; identical to SEQ ID NO: 846749

SEQ ID NO: 846759 - protein, 360 aa, Homo sapiens [sequence omitted]

SEQ ID NO: 846760 - protein, 193 aa, Homo sapiens
MRQQDINDTVRLLKEKCLFTVQQVTKILHSCPSVLREDLGQLEYKFQYAYFRMGIKHPDIVKSEYLQYSLTKIKQRHIYLERLGRYQTPDKKGQTQIPNPLLKDILRVSEAEFLARTACTSVEEFQVFKKLLAREEEESESSTSDDKRASLDEDEDDDDEEDNDEDDNDEDDDDEDDDEAEDNDEDEDDDEEE

SEQ ID NO: 846761 - protein, 241 aa, Homo sapiens
MAAFGRQVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEGKLKRVLYCCPEIFTMRQQDINDTVRLLKEKCLFTVQQVTKILHSCPSVLREDLGQLEYKFQQPRLTA

SEQ ID NO: 846762 - protein, 711 aa, Homo sapiens
AGWLLSGTPLCRQGLHHLHSQGKIHRDIKGANLLLTLQGDVKLADFGVSGELTASVAKRRSFIGTPYWMAPEVAAVERKGGYNELCDVWALGITAIELGELQPPLFHLHPMRALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQELDSPDDTMGTIKRAPFLGPLPTDPPAEEPLSSPPGTLPPPPSGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 846763 - protein, 812 aa, Homo sapiens
APARPAARPARRAMALLRDVSLQDPRDRFELLQRVGAGTYGDVYKVRRDGRESREEGASPAPRAGSSPRPRPPSRFTLLPLQARDTVTSELAAVKIVKLDPGDDISSLQQEITILRECRHPNVVAYIGSYLRNDRLWICMEFCGGGSLQEIYHATGPLEERQIAYVCREATEGAPPPAFSGEDPQRHQADFGVSGELTASVAKRRSFIGTPYWALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQELDSPDDTMGTIKRAPFLGPLPTDPPAEEPLSSPPGTLPPPPSGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 846764 - protein, 751 aa, Homo sapiens
AGWLLSGTPLCRQGLHHLHSQGKIHRDIKGANLLLTLQGDVKLADFGVSGELTASVAKRRSFIGTPYWMAPEVAAVERKGGYNELCDVWALGITAIELGELQPPLFHLHPMRALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQVPHRGRLELGSRPLQRVRLEWDVVTGQPGNGRAGPCPSYQELDSPDDTMGTIKRAPFLGPLPTDPPAEEPLSSPPGTLPPPPSGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 846765 - protein, 711 aa, Homo sapiens; identical to SEQ ID NO: 846762

SEQ ID NO: 846766 - protein, 711 aa, Homo sapiens; identical to SEQ ID NO: 846762

SEQ ID NO: 846767 - protein, 711 aa, Homo sapiens; identical to SEQ ID NO: 846762

SEQ ID NO: 846768 - protein, 95 aa, Homo sapiens
PEHPCCPLELLQPSAQPSWDAGAAVCLQDSVLAFWSHGMQGRSLDTNEVTQEITDETRIFRVLGAHRDIILESIPTDNPEAHSNLYILTGHQSTY

SEQ ID NO: 846769 - protein, 833 aa, Homo sapiens
APARPAARPARRAMALLRDVSLQDPRDRFELLQRVGAGTYGDVYKARDTVTSELAAVKIVKLDPGDDISSLQQEITILRECRHPNVVAYIGSYLRNDRLWICMEFCGGGSLQEIYHATGPLEERQIAYVCRERLKGLHHLHSQGKIHRDIKGANLLLTLQGDVKLADFGVSGELTASVAKRRSFIGTPYWMAPEVAAVERKGGYNELCDVWALGITAIELGELQPPLFHLHPMRALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQELDSPDDTMGTIKRAPFLGPLPTDPPAEEPLSSPPGTLPPPPSGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 846770 - protein, 870 aa, Homo sapiens
APARPAARPARRAMALLRDVSLQDPRDRFELLQRVGAGTYGDVYKVRRDGRESREEGASPAPRAGSSPRPRPPSRFTLLPLQARDTVTSELAAVKIVKLDPGDDISSLQQEITILRECRHPNVVAYIGSYLRNDRLWICMEFCGGGSLQEIYHATGPLEERQIAYVCRERLKGLHHLHSQGKIHRDIKGANLLLTLQGDVKLADFGVSGELTASVAKRRSFIGTPYWMAPEVAAVERKGGYNELCDVWALGITAIELGELQPPLFHLHPMRALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQELDSPDDTMGTIKRAPFLGPLPTDPPAEEPLSSPPGTLPPPPSGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 846771 - protein, 740 aa, Homo sapiens
AGWLLSGTPLCRQGLHHLHSQGKIHRDIKGANLLLTLQGDVKLADFGVSGELTASVAKRRSFIGTPYWMAPEVAAVERKGGYNELCDVWALGITAIELGELQPPLFHLHPMRALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQELDSPDDTMGTIKRAPFLGPLPTDPPAEEPLSSPPGTLPPPPSGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVGKKWAGRGGAGPGGGQRRPSPVPTACSLPVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 846772 - protein, 473 aa, Homo sapiens
PWRMETDPLNEPWEEEWTLLGKEELSGSLLQSVQEALEERSLTIRSASEFQELDSPDDTMGTIKRAPFLGPLPTDPPAEEPLSSPPGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 846773 - protein, 305 aa, Homo sapiens
PWRMETDPLNDRGRKSGHYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 846774 - protein, 723 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846775 - protein, 723 aa, Homo sapiens; identical to SEQ ID NO: 846774

SEQ ID NO: 846776 - protein, 705 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKEGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846777 - protein, 376 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMVWWTVRTFP

SEQ ID NO: 846778 - protein, 677 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHAHITSGRARS

SEQ ID NO: 846779 - protein, 673 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPGDPPTGHPPCHGHRAGDGGCPPLPAHAAAGQDPGGARTAPAAHAGDQPQARAHQEAESAARKRAWPGSAAGGSDIRERHDCCWTC

SEQ ID NO: 846780 - protein, 664 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKTSLTGERTVRRDNHRSTTTEEQTHRLDSARAGHTHRAGEATRQGGAP

SEQ ID NO: 846781 - protein, 664 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPETQEERAQLLQPTLEINPRHALIKKLNQLRASEPGLAQLLVDQIYENAMIAAGLVDDPRAMVGRLNELLVKALERH

SEQ ID NO: 846782 - protein, 600 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPDIRERHDCCWTC

SEQ ID NO: 846783 - protein, 560 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVGERWVGRAPGAATWGGS

SEQ ID NO: 846784 - protein, 608 aa, Homo sapiens
GRRKLRLGTRPGCWVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846785 - protein, 565 aa, Homo sapiens
MPWIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846786 - protein, 616 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846787 - protein, 420 aa, Homo sapiens
EHDALPADLRFQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846788 - protein, 376 aa, Homo sapiens
DAWVDPRVRDKRVGFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846789 - protein, 215 aa, Homo sapiens [sequence omitted]

SEQ ID NO: 846790 - protein, 276 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGNFNSPKLSGILKPGQNLPPP

SEQ ID NO: 846791 - protein, 122 aa, Homo sapiens [sequence omitted]

SEQ ID NO: 846792 - protein, 122 aa, Homo sapiens [sequence omitted]

SEQ ID NO: 846793 - protein, 108 aa, Homo sapiens
MSSSDRFPEQSFHLLRSHPAPAACGLWSLQHSHFSLVDLFSVCVSQCCHVTATCKLSVYTCISLTLPGLLGWLCCLGLVLGLGWRDCSSLGTLFPQCGRWRLPGHKQN

SEQ ID NO: 846794 - protein, 723 aa, Homo sapiens; identical to SEQ ID NO: 846774

SEQ ID NO: 846795 - protein, 560 aa, Homo sapiens; identical to SEQ ID NO: 846783

SEQ ID NO: 846796 - protein, 666 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPR

SEQ ID NO: 846797 - protein, 659 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLANIRERHDCCWTC

SEQ ID NO: 846798 - protein, 560 aa, Homo sapiens; identical to SEQ ID NO: 846783

SEQ ID NO: 846799 - protein, 560 aa, Homo sapiens; identical to SEQ ID NO: 846783

SEQ ID NO: 846800 - protein, 599 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPGLTPQMTAPPP

SEQ ID NO: 846801 - protein, 640 aa, Homo sapiens
TLEQAWIKSDEGSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846802 - protein, 606 aa, Homo sapiens
TRGSTHASETKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846803 - protein, 400 aa, Homo sapiens
PLPIVYGPAWLRAALWEYDMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMIYENAMIAAGLVDDPRAMVGRLNELLVKALERH

SEQ ID NO: 846804 - protein, 493 aa, Homo sapiens
RWSPMQGMSQCHIHLAFPFFACLSSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846805 - protein, 257 aa, Homo sapiens
MREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846806 - protein, 122 aa, Homo sapiens [sequence omitted]

SEQ ID NO: 846807 - protein, 206 aa, Homo sapiens
VIADSRGYTLCSDPPYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846808 - protein, 262 aa, Homo sapiens
EENEEQSFKVEVSYMEIYNEKVRDLLDPKGSRQTLKVREHSVLGPYVDGLSKLAVTSYKDIESLMSEGNKSRTVAATNMNEESSRSHAVFKITLTHTLYDVKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 846809 - protein, 44 aa, Homo sapiens
MKGDDGSPGRDGLDGFPGLPGPPVSSHKLRQLRPLFFILQVLQT

SEQ ID NO: 846810 - protein, 1808 aa, Homo sapiens
ECGCSAPGHQGSALRTQEAPASQPLAPARSRIQAEDRKGPPEPPGPAPREPSKAGRPAGVPPAGASGRANAFGQQPLKPSPRLSGTDRGPEWTNRQLGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 846811 - protein, 1808 aa, Homo sapiens; identical to SEQ ID NO: 846810

SEQ ID NO: 846812 - protein, 169 aa, Homo sapiens [sequence omitted]

SEQ ID NO: 846813 - protein, 107 aa, Homo sapiens
DVSRGSHSRWVRILWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 846814 - protein, 1808 aa, Homo sapiens; identical to SEQ ID NO: 846810

SEQ ID NO: 846815 - protein, 1122 aa, Homo sapiens
ECGCSAPGHQGSALRTQEAPASQPLAPARSRIQAEDRKGPPEPPGPAPREPSKAGRPAGVPPAGASGRANAFGQQPLKPSPRLSGTDRGPEWTNRQLGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILQRLRGAQGLRHPSPHEGPVGGPGPAFYAQCYAQLPCSPQIPLM

SEQ ID NO: 846816 - protein, 1363 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTAPRCP

SEQ ID NO: 846817 - protein, 814 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRESVQVV

SEQ ID NO: 846818 - protein, 829 aa, Homo sapiens
ECGCSAPGHQGSALRTQEAPASQPLAPARSRIQAEDRKGPPEPPGPAPREPSKAGRPAGVPPAGASGRANAFGQQPLKPSPRLSGTDRGPEWTNRQLGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPAAEGIPAAEGIPAAEGIPAAEGIPRP

SEQ ID NO: 846819 - protein, 201 aa, Homo sapiens
ECGCSAPGHQGSALRTQEAPASQPLAPARSRIQAEDRKGPPEPPGPAPREPSKAGRPAGVPPAGASGRANAFGQQPLKPSPRLSGTDRGPEWTNRQLGRDQRAVAGPALRRWLLLGTVTVGFLAQSVLAGVKKFDVPCGGRDCSGGCQCYPEKGGRSSREPGASALPTSSGRTKGQDTSPYPGFSGNTASAGRPSLCKEPT

SEQ ID NO: 846820 - protein, 70 aa, Homo sapiens
AKEMMAGRELRAYQVRSRKTRGHPDPESWAVQEAPLSRPASLRATSKAHTRAKAGLLWLTVVCTNIAAQG

SEQ ID NO: 846821 - protein, 66 aa, Homo sapiens
TPPSTGLAGSCLARFSTMPFLYCNPGDVCYYASRNDKSYWLSTTAREALPMKNVVEKNGPCHTSTP

SEQ ID NO: 846822 - protein, 364 aa, Homo sapiens
ETRKIFSSRDALIALITFNSLKAQEGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 846823 - protein, 1808 aa, Homo sapiens; identical to SEQ ID NO: 846810

SEQ ID NO: 846824 - protein, 1808 aa, Homo sapiens; identical to SEQ ID NO: 846810

SEQ ID NO: 846825 - protein, 1808 aa, Homo sapiens; identical to SEQ ID NO: 846810

SEQ ID NO: 846826 - protein, 1808 aa, Homo sapiens; identical to SEQ ID NO: 846810

SEQ ID NO: 846827 - protein, 141 aa, Homo sapiens
NTPELQAEPHPSCHCWLMIRICIQQQHLDLPATVTERVQALGVPGGQALPTESQEQPWPPSALLDAPPEGTANHFAHTHVTTALSNATDNSTQAASRGQRLRGAQGLRHPSPHEGPVGGPGPAFYAQCYAQLPCSPQIPLM

SEQ ID NO: 846828 - protein, 857 aa, Homo sapiens
ECGCSAPGHQGSALRTQEAPASQPLAPARSRIQAEDRKGPPEPPGPAPREPSKAGRPAGVPPAGASGRANAFGQQPLKPSPRLSGTDRGPEWTNRQLGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAPNFREAMRIGAEVYHN

SEQ ID NO: 846829 - protein, 558 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKVRSNFIMKLARHSEASPGVPFLPFIS

SEQ ID NO: 846830 - protein, 218 aa, Homo sapiens
ECGCSAPGHQGSALRTQEAPASQPLAPARSRIQAEDRKGPPEPPGPAPREPSKAGRPAGVPPAGASGRANAFGQQPLKPSPRLSGTDRGPEWTNRQLGRDQRAVAGPALRRWLLLGTVTVGFLAQSVLAGVKKFDVPCGGRDCSGGCQCYPEKGGRGQPGPVGPQGYNGPPGLQGIEQSLSSGIQRWTQLGPLSRGHTITVSLDAREGSSGKKLNGRS

SEQ ID NO: 846831 - protein, 91 aa, Homo sapiens
IKGPPGDPGYPGIPGTKGTPGEMGPPGLGLPGLKGQRGFPGDAGLPGPPGFLGPPGPAGTPGQIGMKESSLLPFTVLRHSTLSFVSVDVSQ

SEQ ID NO: 846832 - protein, 345 aa, Homo sapiens
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEVGTTPSAPPQRNRRKSVHRVLAELDDESEPPENPPPVLMEPRKKLRVDKAPLTPTGNRRGRPRKYPVSAPMAPPAVGGGEPCAAPCCCLPQEETVAWVQCDGCDVWFHVACVGCSIQAAREADFRCPGCRAGIQT

SEQ ID NO: 846833 - protein, 345 aa, Homo sapiens; identical to SEQ ID NO: 846832

SEQ ID NO: 846834 - protein, 345 aa, Homo sapiens; identical to SEQ ID NO: 846832

SEQ ID NO: 846835 - protein, 345 aa, Homo sapiens; identical to SEQ ID NO: 846832

SEQ ID NO: 846836 - protein, 345 aa, Homo sapiens; identical to SEQ ID NO: 846832

SEQ ID NO: 846837 - protein, 218 aa, Homo sapiens
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTWGSGDHAFCSTPTQSEEICSPSVGGTG

SEQ ID NO: 846838 - protein, 84 aa, Homo sapiens
SKLRPQPLTFSPSWGGPKSLPVPAPPGEVGTTPSAPPQRNRRKSVHRVLAELDDESEPPENPPPVLMEPRKKLRVDKAPLTPTG

SEQ ID NO: 846839 - protein, 345 aa, Homo sapiens; identical to SEQ ID NO: 846832

SEQ ID NO: 846840 - protein, 136 aa, Homo sapiens
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQPQQAPAPAPHLLP

SEQ ID NO: 846841 - protein, 298 aa, Homo sapiens
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEVGTTPSAPPQRNRRKSVHRVLAELDDESEPPENPPPVLMEPRKKLRVDKAPLTPTGNWHIQGMQSIVKGQKERPWPRGEHLSGYEEAS

SEQ ID NO: 846842 - protein, 495 aa, Homo sapiens
GILSGRDGRTALPRPREPAERTAGLRRDMRPQELPRLAFPLLLLLLLLLPPPPCPAHSATRFDPTWESLDARQLPAWFDQAKFGIFIHWGVFSVPSFGSEWFWWYWQKEKIPKYVEFMKDNYPPSFKYEDFGPLFTAKFFNANQWADIFQASGAKYIVLTSKHHEGFTLWGSEYSWNWNAIDEGPKRDIVKELEVAIRNRTDLRFGLYYSLFEWFHPLFLEDESSSFHKRQFPVSKTLPELYELVNNYQPEVLWSDGDGGAPDQYWNSTGFLAWLYNESPVRGTVVTNDRWGAGSICKHGGFYTCSDRYNPGHLLPHKWENCMTIDKLSWGYRREAGISDYLTIEELVKQLVETVSCGGNLLMNIGPTLDGTISVVFEERLRQMGSWLKVNGEAIYETHTWRSQNDTVTPDVWYTSKPKEKLVYAIFLKWPTSGQLFLGHPKAILGATEVKLLGHGQPLNWISLEQNGIMVELPQLTIHQMPCKWGWALALTNVI

SEQ ID NO: 846843 - protein, 495 aa, Homo sapiens; identical to SEQ ID NO: 846842

SEQ ID NO: 846844 - protein, 458 aa, Homo sapiens
GILSGRDGRTALPRPREPAERTAGLRRDMRPQELPRLAFPLLLLLLLLLPPPPCPAHSATRFDPTWESLDARQLPAWFDQAKFGIFIHWGVFSVPSFGSEWFWWYWQKEKIPKYVEFMKDNYPPSFKYEDFGPLFTAKFFNANQWADIFQASGAKYIVLTSKHHEGFTLWGSEYSWNWNAIDEGPKRDIVKELEVAIRNRTDLRFGLYYSLFEWFHPLFLEDESSSFHKRQFPVSKTLPELYELVNNYQPEVLWSDGDGGAPDQYWNSTGFLAWLYNESPVRGTVVTNDRWGAGSICKHGGFYTCSDRYNPGHLLPHKWENCMTIDKLSWGYRREAGISDYLTIEELVKQLVETVSCGGNLLMNIGPTLDGTISVVFEERLRQMGSWLKVNGEAIYETHTWRSQNDTVTPDVWYTSKPKEKLVYAIFLKWPTSGQLFLGHPKAILGATEVRGNFTLFL

SEQ ID NO: 846845 - protein, 276 aa, Homo sapiens [sequence omitted]

SEQ ID NO: 846846 - protein, 495 aa, Homo sapiens; identical to SEQ ID NO: 846842

SEQ ID NO: 846847 - protein, 351 aa, Homo sapiens
GILSGRDGRTALPRPREPAERTAGLRRDMRPQELPRLAFPLLLLLLLLLPPPPCPAHSATRFDPTWESLDARQLPAWFDQAKFGIFIHWGVFSVPSFGSEWFWWYWQKEKIPKYVEFMKDNYPPSFKYEDFGPLFTAKFFNANQWADIFQASGAKYIVLTSKHHEGFTLWGSEYSWNWNAIDEGPKRDIVKELEVAIRNRTDLRFGLYYSLFEWFHPLFLEDESSSFHKRQFPVSKTLPELYELVNNYQPEVLWSDGDGGAPDQYWNSTGFLAWLYNESPVRGTVVTNDRWGAGSICKHGGFYTCSDRYNPGHLLPHKWENCMTIDKLSWGYRREAGISDYLTIEELVKVQ

SEQ ID NO: 846848 - protein, 316 aa, Homo sapiens
MLGEAPAAPRLAGSEARSLWQGTQVSALHRRIKAIVEVAAMCGVNIICFQEAWTMPFAFCTREKLPWTEFAESAEDGPTTRFCQKLAKNHDMVVVSPILERDSEHGDVLWNTAVVISNSGAVLGKTRKNHIPRVGDFNESTYYMEGNLGHPVFQTQFGRIAVNICYGRHHPLNWLMYSINGAEIIFNPSATIGALSESLWPIEARNAAIANHCFTCAINRVGTEHFPNEFTSGDGKKAHQDFGYFYGSSYVAAPDSSRTPGLSRSRDGLLVAKLDLNLCQQVNDVWNFKMTGRYEMYARELAEAVKSNYSPTIVKE

SEQ ID NO: 846849 - protein, 323 aa, Homo sapiens [sequence omitted]

SEQ ID NO: 846850 - protein, 366 aa, Homo sapiens
MAGAEWKSLEECLEKHLPLPDLQEVKRVLYGKELRKLDLPREAFEAASREDFELQGYAFEAAEEQLRRPRIVHVGLVQNRIPLPANAPVAEQVSALHRRIKAIVEVAAMCGVNIICFQEAWTMPFAFCTREKLPWTEFAESAEDGPTTRFCQKLAKNHDMVVVSPILERDSEHGDVLWNTAVVISNSGAVLGKTRRKPGPPRVPDAVRKDRGEHLLRAAPPLNWLMYSINGAEIIFNPSATIGALSESLWPIEARNAAIANHCFTCAINRVGTEHFPNEFTSGDGKKAHQDFGYFYGSSYVAAPDSSRTPGLSRSRDGLLVAKLDLNLCQQVNDVWNFKMTGRYEMYARELAEAVKSNYSPTIVKE

SEQ ID NO: 846851 - protein, 147 aa, Homo sapiens
MPAAGPSQRLFRPGQGAEDRLAWLQVWGVTGESPGCPHHWPRKACSQARLCPHHWPRKACSQARLRAEHPLSLPGKSATWFLLVLSYSESLWPIEARNAAIANHCFTCAINRVGTLTRTLATFMARAMWQPLTAAGLLGCPVAGMDC

SEQ ID NO: 846852 - protein, 131 aa, Homo sapiens
MRDRPFGPQHLADTGEDGMDSVSWACLKVPDPLWSPQCIYTSSQMCFFVPLKAHQDFGYFYGSSYVAAPDSSRTPGLSRSRDGLLVAKLDLNLCQQVNDVWNFKMTGRYEMYARELAEAVKSNYSPTIVKE

SEQ ID NO: 846853 - protein, 323 aa, Homo sapiens [sequence omitted]

SEQ ID NO: 846854 - protein, 327 aa, Homo sapiens [sequence omitted]

SEQ ID NO: 846855 - protein, 151 aa, Homo sapiens [sequence omitted]

SEQ ID NO: 846856 - protein, 384 aa, Homo sapiens
MAGAEWKSLEECLEKHLPLPDLQEVKRVLYGKELRKLDLPREAFEAASREDFELQGYAFEAAEEQLRRPRIVHVGLVQNRIPLPANAPVAEQVSALHRRIKAIVEVAAMCGVNIICFQEAWTMPFAFCTREKLPWTEFAESAEDGPTTRFCQKLAKNHDMVVVSPILERDSEHGDVLWNTAVVISNSGAVLGKTRKNHIPRVGDFNESTYYMEGNLGHPVFQTQFGRIAVNICYGRHHPLNWLMYSINGAEIIFNPSATIGALSESLWPIEARNAAIANHCFTCAINRVGTEHFPNEFTSGDGKKAHQDFGYFYGSSYVAAPDSSRTPGLSRSRDGLLVAKLDLNLCQQVNDVWNFKMTGRYEMYARELAEAVKSNYSPTIVKE

SEQ ID NO: 846857 - protein, 409 aa, Homo sapiens
MAGAEWKSLEECLEKHLPLPDLQEVKRVLYGKELRKLDLPREAFEAASREDFELQGYAFEAAEEQLRRPRIVHVGLVQNRIPLPANAPVAEQVSALHRRIKAIVEVAAMCGVNIICFQEAWTAGLVTLDTVSRSTPHRDGSSQVARAMPFAFCTREKLPWTEFAESAEDGPTTRFCQKLAKNHDMVVVSPILERDSEHGDVLWNTAVVISNSGAVLGKTRKNHIPRVGDFNESTYYMEGNLGHPVFQTQFGRIAVNICYGRHHPLNWLMYSINGAEIIFNPSATIGALSESLWPIEARNAAIANHCFTCAINRVGTEHFPNEFTSGDGKKAHQDFGYFYGSSYVAAPDSSRTPGLSRSRDGLLVAKLDLNLCQQVNDVWNFKMTGRYEMYARELAEAVKSNYSPTIVKE

SEQ ID NO: 846858 - protein, 208 aa, Homo sapiens
MPAAGPSQRLFRPGQGAEDRLAWLQVWGVTGESPGCPHHWPRKACSQARLCPHHWPRKACSQARLRAEHPLSLPGKSATWFLLVLSYSESLWPIEARNAAIANHCFTCAINRVGTEHFPNEFTSGDGKKAHQDFGYFYGSSYVAAPDSSRTPGLSRSRDGLLVAKLDLNLCQQVNDVWNFKMTGRYEMYARELAEAVKSNYSPTIVKE

SEQ ID NO: 846859 - protein, 384 aa, Homo sapiens; identical to SEQ ID NO: 846856

SEQ ID NO: 846860 - protein, 327 aa, Homo sapiens [sequence omitted]

SEQ ID NO: 846861 - protein, 332 aa, Homo sapiens
MSQEGVELEKSVRRLREKFHGKVSSKKAGALMRKFGSDHTGVGRSIVYGVKQKDGQELSNDLDAQDPPEDMKQDRDIQAVATSLLPLTEANLRMFQRAQDDLIPAVDRQFACSSCDHVWWRRVPQRKEVSRCRKCRKRYEPVPADKMWGLAEFHCPKCRHNFRLRALTPSSPSALPYPSPAPPCPGPTLAQPRPRTLTALPAPRGWAQMGSPSPCYGCGFPVYPTRILPPRWDRDPDRRSTHTHSCSAADCYNRREPHVPGTSCAHPKSRKQNHLPKVLHPSNPHISSGSTVATCLSQGGLLEDLDNLILEDLKEEEEEEEEVEDEEGGPRE

SEQ ID NO: 846862 - protein, 90 aa, Homo sapiens
TTRRGRVGRPRVGEPHVPGTSCAHPKSRKQNHLPKVLHPSNPHISSGSTVATCLSQGGLLEDLDNLILEDLKEEEEEEEEVEDEEGGPRE

SEQ ID NO: 846863 - protein, 291 aa, Homo sapiens
MSQEGVELEKSVRRLREKFHGKVSSKKAGALMRKFGSDHTGVGRSIVYGVKQKDGQELSNDLDAQDPPEDMKQDRDIQAVATSLLPLTEANLRMFQRAQDDLIPAVDRQFACSSCDHVWWRRVPQRKEVSRCRKCRKRYEPVPADKMWGLAEFHCPKCRHNFRGWAQMGSPSPCYGCGFPVYPTRILPPRWDRDPDRRSTHTHSCSAADCYNRREPHVPGTSCAHPKSRKQNHLPKVLHPSNPHISSGSTVATCLSQGGLLEDLDNLILEDLKEEEEEEEEVEDEEGGPRE

SEQ ID NO: 846864 - protein, 106 aa, Homo sapiens
MSQEGVELEKSVRRLREKFHGKVSSKKAGALMRKFGSDHTGVGRSIVYGVKQKDGQELSNDLDAQVTYPLPSQRTGSREGEQEGGPDPFMVTDPPLKQEGPGIVGP

SEQ ID NO: 846865 - protein, 291 aa, Homo sapiens; identical to SEQ ID NO: 846863

SEQ ID NO: 846866 - protein, 240 aa, Homo sapiens
MSQHQQACGICRQEDPPEDMKQDRDIQAVATSLLPLTEANLRMFQRAQDDLIPAVDRQFACSSCDHVWWRRVPQRKEVSRCRKCRKRYEPVPADKMWGLAEFHCPKCRHNFRGWAQMGSPSPCYGCGFPVYPTRILPPRWDRDPDRRSTHTHSCSAADCYNRREPHVPGTSCAHPKSRKQNHLPKVLHPSNPHISSGSTVATCLSQGGLLEDLDNLILEDLKEEEEEEEEVEDEEGGPRE

SEQ ID NO: 846867 - protein, 291 aa, Homo sapiens; identical to SEQ ID NO: 846863

SEQ ID NO: 846868 - protein, 102 aa, Homo sapiens
RWVCKAGGLWALLWVQTSLRKSLVICEEMTSLLKRRMHPGSLLCLLRMTLHGLWNLEQVGREVKKGCFSFNSHPSLPKGDHVTGIHGLVRREKCSAPLSYTC

SEQ ID NO: 846869 - protein, 382 aa, Homo sapiens
RPGPRGCPAPASPRLPGPAPRRSFSDSRRGCPASCSARPARLSPRVVARHSRAMTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846870 - protein, 269 aa, Homo sapiens
MTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846871 - protein, 311 aa, Homo sapiens
MREQTNKGTKKPHLVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846872 - protein, 311 aa, Homo sapiens
LGAFCVEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846873 - protein, 382 aa, Homo sapiens; identical to SEQ ID NO: 846869

SEQ ID NO: 846874 - protein, 226 aa, Homo sapiens
MNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846875 - protein, 419 aa, Homo sapiens
RPGPRGCPAPASPRLPGPAPRRSFSDSRRGCPASCSARPARLSPRVVARHSRAMTTQQIDLQGPGPWGFRLVGGKDFEQPLAISRSLLEARRCLCHNISGMWMISTSASPLACGRETIVDTVMYLRRDISQREIYNGRSDLRSETSWNIIHHADDQELLNTKDTLLGCSLREVHWHGERATRSISSEQRMHILYPREAAMSEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846876 - protein, 238 aa, Homo sapiens
RIHVAFQQRHDYPADRPPGQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846877 - protein, 348 aa, Homo sapiens
RPGPRGCPAPASPRLPGPAPRRSFSDSRRGCPASCSARPARLSPRVVARHSRAMTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPETEGPFLCGGSNLL

SEQ ID NO: 846878 - protein, 207 aa, Homo sapiens
RPGPRGCPAPASPRLPGPAPRRSFSDSRRGCPASCSARPARLSPRVVARHSRAMTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQGIPTSPQDSEVLKLLSLKWLRRLEMLRSCLCVTNVALGLLVCL

SEQ ID NO: 846879 - protein, 135 aa, Homo sapiens
MALLEHIFMSGSEELSDTYAILPFLANDSVFLISGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846880 - protein, 122 aa, Homo sapiens
AVIELGTGVVGFAGNPGVQEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846881 - protein, 321 aa, Homo sapiens
RPGPRGCPAPASPRLPGPAPRRSFSDSRRGCPASCSARPARLSPRVVARHSRAMTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIV

SEQ ID NO: 846882 - protein, 214 aa, Homo sapiens
MGPTTPRKTAPTTKTRRAPKTATKTPPQPHSHTTQPGEDSNKRACPQSNTSKRQKANPPRRRRRHNRRQQLHNPNESNNPTRRRDKHNTRHRQQANAQQPTPRHDEQANETTTGRRARTPKAPANQPRRTDPKERDINKQTRDERRESRRKADRAQHEKRRTAKRKQKSKEKNTEKDKQNQTTKTTAEKQPKRSETDTRTSKEQNKKKERSAGR

SEQ ID NO: 846883 - protein, 269 aa, Homo sapiens; identical to SEQ ID NO: 846870

SEQ ID NO: 846884 - protein, 382 aa, Homo sapiens; identical to SEQ ID NO: 846869

SEQ ID NO: 846885 - protein, 382 aa, Homo sapiens; identical to SEQ ID NO: 846869

SEQ ID NO: 846886 - protein, 303 aa, Homo sapiens
RPGPRGCPAPASPRLPGPAPRRSFSDSRRGCPASCSARPARLSPRVVARHSRAMTTQQIDLQGPGPWGFRLVGGKDFEQPLAISREVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846887 - protein, 231 aa, Homo sapiens
RPGPRGCPAPASPRLPGPAPRRSFSDSRRGCPASCSARPARLSPRVVARHSRAMTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALRPCSASKQPCHRQRI

SEQ ID NO: 846888 - protein, 297 aa, Homo sapiens
MSWSTSWLTDEGKRSSITIAGTYETRSAEHAQAKESLRLPYEEGSRIELTVVVAYWAPFLIAGPFRPQAVRKSTNRAKGGATPTIIAKLQYKARESWGACIRSMPGEIVNLPGHFTNESDAAGKIHKDVRDRGRGWKVGTGEDPLVLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 846889 - protein, 400 aa, Homo sapiens
RPGPRGCPAPASPRLPGPAPRRSFSDSRRGCPASCSARPARLSPRVVARHSRAMTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPLSSLESSLLTLVFPLLVKH

SEQ ID NO: 846890 - protein, 333 aa, Homo sapiens
RPGPRGCPAPASPRLPGPAPRRSFSDSRRGCPASCSARPARLSPRVVARHSRAMTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPCQQHCVPSPRRSSLLHLDISQI

SEQ ID NO: 846891 - protein, 289 aa, Homo sapiens
RPGPRGCPAPASPRLPGPAPRRSFSDSRRGCPASCSARPARLSPRVVARHSRAMTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKEVISSICS

SEQ ID NO: 846892 - protein, 243 aa, Homo sapiens
AGCGLGEDSVTGLGLWGGLTLVYLPGPAGLWSVAFSFGGRGFVPERGTCPAYPVPGALQPQMPPPYSSSRLYPGEWHTTPPRPTSALSQMVTRGCCLPAALLGPDNHPANQTQPWMNLWPKHAVDPTVGANRQVGKLSQGLPLVELRGAARGGAGEEGPRGGASVQSWRVSAVQEAGALRKQVCPPPALPGTFVGVPRAQAPGSGEWGWLREGQAGFCWQGSPTPLLSTPFPLVLSVHRTVGQ

SEQ ID NO: 846893 - protein, 778 aa, Homo sapiens
MLPPLIDPWDPGLTARDLLFRGGYRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGETLLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQPQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 846894 - protein, 847 aa, Homo sapiens
MLPPLIDPWDPGLTARDLLFRGGYRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGESKALIYTFLPHWLTCYLTPGPFHPSSALLAVRSDYHCAVWKFGKQWQPTLLQAMQVEKGATGISLSPHLPGELAICSRSGAVCLWSPEDGYRRFLLKPPTLNELNSALLSMSRPLSPFPISLPPAHGLPVSPRLRQIYRDPETLVFRDSSSWRWADFTAHPRVLTVGDRTGVKMLDTQGPPGCGLLLFRLGAEASCQKGERVLLTQYLGHSSPKCLPPTLHLVCTQPQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 846895 - protein, 791 aa, Homo sapiens
MGYRRPRLELEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGESKALIYTFLPHWLTCYLTPGPFHPSSALLAVRSDYHCAVWKFGKQWQPTLLQAMQVEKGATGISLSPHLPGELAICSRSGAVCLWSPEDGYRRFLETPHPNELNSALLSMSRPLSPFPISLSPCPRLPVSPRLRQIYRDPETLVFRDSSSWRWADFTAHPRVLTVGDRTGVKMLDTQGPPGCGLLLFRLGAEASCQKGERVLLTQYLGHSSPKCLPPTLHLVCTQPQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 846896 - protein, 740 aa, Homo sapiens
MLPPLIDPWDPGLTARDLLFRGGYRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGETLLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQPQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPLAPSSTHPSSLALSPSGRSLEWASEDTRWAALKPQRAPHPSSGTRCAFHS

SEQ ID NO: 846897 - protein, 778 aa, Homo sapiens; identical to SEQ ID NO: 846893

SEQ ID NO: 846898 - protein, 778 aa, Homo sapiens; identical to SEQ ID NO: 846893

SEQ ID NO: 846899 - protein, 489 aa, Homo sapiens
MLPPLIDPWDPGLTARDLLFRGGYRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGETLLAVRSDYHCAVWKFGKQWQPTLLQAMQVEKGATGISLSPHLPGELAICSRSGAVCLWSPEDGLREIYRDPMKTTRCTGTPSISRTDRGQDIQMSNPIRDAEPDADGPDNRSDKNDWTNIQGPARADGSAAFTDKERQKASEAQDTGKQETQAKPKYPGGENPEPKMTPHRKLTTPVRTHEVISNRRAEAIPLEARKVDRGTHTEEKNAGDQARHRSNPEGKTGGGKRKRKKEKQHKHEKPRQTENSGRKEKKNKEHKKPEIEDKQTETQGPDDES

SEQ ID NO: 846900 - protein, 303 aa, Homo sapiens
PLVPMLKWNHGLPSPLLLARLLPPPRPSCVQPLLLGGQGGQLQLLHLAGEGPGQGGRRVGDGAGRGLDRASAVCPSSGEGASVPRLAGPPQSLPSRIDSLPAFPLLEPKIQWRLQERLKAPTIGVLGGGVSLGGAVENIPSPRWPWRSLSFPSPGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLED

SEQ ID NO: 846901 - protein, 871 aa, Homo sapiens
MDFPSSLRPALFLTGPLGLSDVPDLSFMCSWRDALTLPEAQPQNSENGALHVTKDLLWEPATPGPLPMLPPLIDPWDPGLTARDLLFRGGYRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGESKALIYTFLPHWLTCYLTPGPFHPSSALLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQPQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 846902 - protein, 695 aa, Homo sapiens
MDFPSSLRPALFLTGPLGLSDVPDLSFMCSWRDALTLPEAQPQNSENGALHVTKDLLWEPATPGPLPMLPPLIDPWDPGLTARDLLFRGGYRYRKRPRVVLDVTEQISRFLLDHGDVAFAPLGKLMLENLCWPSALTTTVPCGSLVNSGSQPFCRQCRWRKGPRGSASALTCPGSWPSAAAREPSACGALRMGCGNIYRDPETLVFRDSSSWRWADFTAHPRVLTVGDRTGVKMLDTQGPPGCGLLLFRLGAEASCQKGERVLLTQYLGHSSPKCLPPTLHLVCTQPQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 846903 - protein, 462 aa, Homo sapiens
MLDTQGPPGCGLLLFRLGAEASCQKGERVLLTQYLGHSSPKCLPPTLHLVCTQPQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 846904 - protein, 453 aa, Homo sapiens
GTWRLMGDAAAPQGSALTWRATWGLEGHYTAQLPSSATSPFLLGPQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 846905 - protein, 778 aa, Homo sapiens; identical to SEQ ID NO: 846893

SEQ ID NO: 846906 - protein, 539 aa, Homo sapiens
MLPPLIDPWDPGLTARDLLFRGGYRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGETLLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQVSGYTTPPRPTSALSQMVTRGCCLPAALLGPDNHPANQTQPWMNLWPKHAVDPTVGANRQVGKLSQGLPLVELRGAARGGAGEEGPRGGASVQSWRVSAVQEAGALRKQVCPPPALPGTFVGVPRAQAPGSGEWGWLREGQAGFCWQGSPTPLLSTPFPLVLSVHRTVGQ

SEQ ID NO: 846907 - protein, 330 aa, Homo sapiens
MLPPLIDPWDPGLTARDLLFRGGYRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGETLLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQVRAGGRGPT

SEQ ID NO: 846908 - protein, 80 aa, Homo sapiens
LSNSIQATTDEEGSVSNIATEIKDGEKSGTVSSQKKPALKATSDEKDSFSNITREKKDGEISRTGISKQVSKVINSGLFH

SEQ ID NO: 846909 - protein, 305 aa, Homo sapiens
MKCKDCVHLLKIKNTFCLWKRLIKLKDNHCEQLRVKIRKLKNKASVLQKRISEKEEIKSQLKHEILELEKELCSLRFAIQQEKKKRRNVEEVHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNGETLAKTIACYSGQLAALTDENTTLRSKLEKQRESRQRLETEMQSYHCRLNAARCDHDQSHSSKRDQELAFQGTVDKCRHLQENLNSHVLILSLQLSKAESKSRVLK

SEQ ID NO: 846910 - protein, 317 aa, Homo sapiens
PQVMRKDSFSNITREKKDGEISGTVSSQKPPALKAASDKTDSALNTATEIKDGLQCGTVSSQKQQALKATTDEEGSVSNIATEIKDGEKSGTVSSQKKPALKATSDKKDSVPNMATETKDEQISGTVSSQKQPALKATSDKKDSVSNIPTEIKDGQQSGTVSSQKQPAWKATSVKKDSVSNIATEIKDGQIRGTVSSQRRPALKTTGDEKDSVSNIAREIKDGEKSGTVSPQKQSAQKVIFKKKVSLLNIATRITGGGKSGTEYPENLRTLKATIENKDSVTHRGFHHVGLAVPQCLYCMENIDNILPFHHFNNDAY

SEQ ID NO: 846911 - protein, 338 aa, Homo sapiens
MYILVQRMNEYMLKMHSPLYPKIYSCILSLLCFFLVTDCVHLLKIKNTFCLWKRLIKLKDNHCEQLRVKIRKLKNKASVLQKRISEKEEIKSQLKHEILELEKELCSLRFAIQQEKKKRRNVEEVHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNGETLAKTIACYSGQLAALTDENTTLRSKLEKQRESRQRLETEMQSYHCRLNAARCDHDQSHSSKRDQELAFQGTVDKCRHLQENLNSHVLILSLQLSKAESKSRVLK

SEQ ID NO: 846912 - protein, 635 aa, Homo sapiens
PQVMRKDSFSNITREKKDGEISGTVSSQKPPALKAASDKTDSALNTATEIKDGLQCGTVSSQKQQALKATTDEEGSVSNIATEIKDGEKSGTVSSQKKPALKATSDKKDSVPNMATETKDEQISGTVSSQKQPALKATSDKKDSVSNIPTEIKDGQQSGTVSSQKQPAWKATSVKKDSVSNIATEIKDGQIRGTVSPQKQSAQKVIFKKKVSLLNIATRITGGGKSGTEYPENLPTLKATIENKNSVLNTATKMKDVQTSTPAEQDLEMASEGEQKRLEEYENNQPQVKNQIHSRDDLDDIIQSSQTVSEDGDSLCCNCKNVILLIDQHEMKCKDCVHLLKIKNTFCLWKRLIKLKDNHCEQLRVKIRKLKNKASVLQKRISEKEEIKSQLKHEILELEKELCSLRFAIQQEKKKRRNVEEVHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNGETLAKTIACYSGQLAALTDENTTLRSKLEKQRESRQRLETEMQSYHCRLNAARCDHDQSHSSKRDQELAFQGTVDKCRHLQENLNSHVLILSLQLSKAESKSRVLK

SEQ ID NO: 846913 - protein, 424 aa, Homo sapiens
PQVMRKDSFSNITREKKDGEISGTVSSQKPPALKAASDKTDSALNTATEIKDGLQCGTVSSQKQQALKATTDEEGSVSNIATEIKDGEKSGTVSSQKKPALKATSDKKDSVPNMATETKDEQISGTVSSQKQPALKATSDKKDSVSNIPTEIKDGQQSGTVSSQKQPAWKATSVKKDSVSNIATEIKDGQIRGTVSPQKQSAQKVIFKKKVSLLNIATRITGGGKSGTEYPENLPTLKATIENKNSVLNTATKMKDVQTSTPAEQDLEMASEGEQKRLEEYENNQPQVKNQIHSRDDLDDIIQSSQTVSEDGDSLCCNCKNVILLIDQHEMKCKDCVHLLKIKNTFCLWKRLIKLKDNHCEQLRVKIRKLKNKASVLQKRISEKEEIKSQLKHEILELEKELCSLRYDLVLNKCLNCLFYIKDV

SEQ ID NO: 846914 - protein, 774 aa, Homo sapiens
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENFLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQPHLCIQYEVLEAAQLAIESLDGILVDGICIKVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 846915 - protein, 774 aa, Homo sapiens; identical to SEQ ID NO: 846914

SEQ ID NO: 846916 - protein, 774 aa, Homo sapiens; identical to SEQ ID NO: 846914

SEQ ID NO: 846917 - protein, 774 aa, Homo sapiens; identical to SEQ ID NO: 846914

SEQ ID NO: 846918 - protein, 670 aa, Homo sapiens [sequence omitted]

SEQ ID NO: 846919 - protein, 628 aa, Homo sapiens
MQFWANPMFQNPGPLPSNAKAAINLQDDPIIQKYGSKKVGLTRCLLTKEEMRTFHFPLQGFPDCENFLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQPHLCIQYEVLEAAQLAIESLDGILVDGICIKVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 846920 - protein, 517 aa, Homo sapiens
MDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQPHLCIQYEVLEAAQLAIESLDGILVDGICIKVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 846921 - protein, 517 aa, Homo sapiens; identical to SEQ ID NO: 846920

SEQ ID NO: 846922 - protein, 528 aa, Homo sapiens
MLVFQCLTSKGRELTRISLVAEGGCCVMDELVKPENKILDYLTSFSGITKKILNPVTTKLKDVQRQLKALLPPDAVLVGHSLDLDLRALKQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQPHLCIQYEVLEAAQLAIESLDGILVDGICIKVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 846923 - protein, 743 aa, Homo sapiens
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENFLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 846924 - protein, 517 aa, Homo sapiens; identical to SEQ ID NO: 846920

SEQ ID NO: 846925 - protein, 708 aa, Homo sapiens
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENFLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEMRIKWTEISTVYAGPFSKNCNLRALKRLFKSFGPVQSMTFVLETRQVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 846926 - protein, 670 aa, Homo sapiens [sequence omitted]

SEQ ID NO: 846927 - protein, 544 aa, Homo sapiens
MLVFQCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQPHLCIQYEVLEAAQLAIESLDGILVDGICIKVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 846928 - protein, 216 aa, Homo sapiens
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGLAEAYSDIAN

SEQ ID NO: 846929 - protein, 151 aa, Homo sapiens
MSGRAGFFQLRLPTLPSYPGGCAAPRGISITAKEKTLGVQVPFAPGVDSPAGVHTPTGAPSGHPPQSVPHAHPPSKEGFSLFSSWGKEERRGGKKREAADGKRRINVHLVLPAKSREGTHRGAAKRELPIKTGTESPGSGGGGGAGRVTSP

SEQ ID NO: 846930 - protein, 151 aa, Homo sapiens; identical to SEQ ID NO: 846929

SEQ ID NO: 846931 - protein, 151 aa, Homo sapiens; identical to SEQ ID NO: 846929

SEQ ID NO: 846932 - protein, 151 aa, Homo sapiens; identical to SEQ ID NO: 846929

SEQ ID NO: 846933 - protein, 151 aa, Homo sapiens; identical to SEQ ID NO: 846929

SEQ ID NO: 846934 - protein, 150 aa, Homo sapiens
MLILTYHPTVHSWNPTAGQTMPRAAYVKTGICPYCREPASHAWRPRAGARRHRTVLLPLRPLRTETDHRLGAGVSVRAAGRASEGEEGEGEGRSPGRGGITAQAADTRAWGGLGPRKERNVYRIYLPDSSDRDPVGHSPSPHFHLPTQTL

SEQ ID NO: 846935 - protein, 151 aa, Homo sapiens; identical to SEQ ID NO: 846929

SEQ ID NO: 846936 - protein, 151 aa, Homo sapiens; identical to SEQ ID NO: 846929

SEQ ID NO: 846937 - protein, 71 aa, Homo sapiens
SREMPGPQVAQQLFAVANACRTAQAADTRAWGGLGPRKERNVYRIYLPDSSDRDPVGHSPSPHFHLPTQTL

SEQ ID NO: 846938 - protein, 1303 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPASYKRAIGEDFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 846939 - protein, 288 aa, Homo sapiens
LQRRAERGTPKPPGPPAQPPGPPNASSNPDLRRSDPGWERSDSVLPASHGHLPQAGSLERNRVGVSSKPDSSPVLSPGNKAKPDDHRSRPGRPAVSHLVAGMACLILVWGLASGCWVSGVGSPLIYREGLWGWRELVLLMVLTFPNLSPNLSPNLSSGSFFPCGPSQSYKRAIGEVSEMGLLVGAPPVALLGCPGTLCLPPPRPSFSLPLSGSSLQDFVLLKERTLDEAPRPPKKAMDYSSSSEEVESSEDDEEEGEGGPAEGSRDTPGGRYGIGSGALPLQGTGREG

SEQ ID NO: 846940 - protein, 1295 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 846941 - protein, 1295 aa, Homo sapiens; identical to SEQ ID NO: 846940

SEQ ID NO: 846942 - protein, 1295 aa, Homo sapiens; identical to SEQ ID NO: 846940

SEQ ID NO: 846943 - protein, 1295 aa, Homo sapiens; identical to SEQ ID NO: 846940

SEQ ID NO: 846944 - protein, 1401 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYIRHRLEEEQRQLEILQQQLLQEQALLLVTGPSASSGKMLFRASLLERDGNTSREGIHPGHQGNTSPLQAVGEKRGHACSNSQGHTLLSPLSYPWAQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPASYKRAIGEDFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 846945 - protein, 1324 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYIRHRLEEEQRQLEILQQQLLQEQALLLEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 846946 - protein, 626 aa, Homo sapiens
LQRRAERGTPKPPGPPAQPPGPPNASSNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 846947 - protein, 382 aa, Homo sapiens [sequence omitted]

SEQ ID NO: 846948 - protein, 1278 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKLRHPPNLSPW

SEQ ID NO: 846949 - protein, 752 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPPWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 846950 - protein, 1249 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFRTTTKTLVQSAYLRLRLNRNIRYHLLSSTLQPPHYQALRRITVEYNLENHAKGDPKPRRDTHSQADSSL

SEQ ID NO: 846951 - protein, 257 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKK

SEQ ID NO: 846952 - protein, 164 aa, Homo sapiens
IRSRGSRGITMSEVIDRSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKDPSFPGGEPHIQDR

SEQ ID NO: 846953 - protein, 93 aa, Homo sapiens
MDLGARDLGPGWGSVVTDHGEAPVAQEGKSQHPSSLPPPVKYERIKFLVIALKSSVEVYAWAPKPYHKFMAFKVIPASVPNTIWSPSASPRAP

SEQ ID NO: 846954 - protein, 104 aa, Homo sapiens
MEGGPATTMNSKGQYPTQPTYPVQPPGNPVYPQTLHLPQAPPYTDAPPAYSELYRPSFVHPGAATVPTMSAAFPGASLYLPMAQSVAVGPLGSTIPMAYYPFIK

SEQ ID NO: 846955 - protein, 184 aa, Homo sapiens
IRSRGSRGITMSEVIDRSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDLGVSVSWTRGR

SEQ ID NO: 846956 - protein, 1295 aa, Homo sapiens; identical to SEQ ID NO: 846940

SEQ ID NO: 846957 - protein, 1295 aa, Homo sapiens; identical to SEQ ID NO: 846940

SEQ ID NO: 846958 - protein, 1295 aa, Homo sapiens; identical to SEQ ID NO: 846940

SEQ ID NO: 846959 - protein, 1295 aa, Homo sapiens; identical to SEQ ID NO: 846940

SEQ ID NO: 846960 - protein, 1275 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 846961 - protein, 707 aa, Homo sapiens
LQRRAERGTPKPPGPPAQPPGPPNASSNPDLRRSDPGWERSDSVLPASHGHLPQAGSLERNRVGVSSKPDSSPVLSPGNKAKPDDHRSRPGRPAVSHLVAGMACLILVWGLASGCWVSGVGSPLIYREGLWGWRELVLLMVLTFPNLSPNLSPNLSSGSFFPCGPSQSYKRAIGEDFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 846962 - protein, 1283 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVGGSFPLKALLSRLP

SEQ ID NO: 846963 - protein, 1283 aa, Homo sapiens; identical to SEQ ID NO: 846962

SEQ ID NO: 846964 - protein, 1181 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSHLRPPAHTNAQAHTHTQHTHANAAHTNTAHTAHTR

SEQ ID NO: 846965 - protein, 113 aa, Homo sapiens
WLPSAAFGTSVATGRTWRGPTFLSHSSDGDTDSVSTMVVHDVEEITGTQPPYGGGTMVVQRVSEPLLPPLYLCVPSSAPRQPCPLSCRPLKRSGTCCMLTAMGTQTCLTWSSP

SEQ ID NO: 846966 - protein, 509 aa, Homo sapiens
MAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKETAHSVLGSDANDVVITVPFDFGEKQKNALGEAARAAGFNVLRLIHEPSAALLAYGIGQDSPTGKSNILVFKLGGTSLSLSVMEVNSGIYRVLSTNTDDNIGGAHFTETLAQYLASEFQRSFKHDVRGNARAMMKLTNSAEVAKHSLSTLGSANCFLDSLYEGQDFDCNVSRARFELLCSPLFNKCIEAIRGLLDQNGFTADDINKVVLCGGSSRIPKLQQLIKDLFPAVELLNSIPPDEVIPIGAAIEAGILIGKENLLVEDSLMIECSARDILVKGVDESGASRFTVLFPSGTPLPARRQHTLQAPGSISSVCLELYESDGKNSAKEETKFAQVVLQDLDKKENGLRDILAVLTMKRDGSLHVTCTDQETGKCEAISIEIAS

SEQ ID NO: 846967 - protein, 361 aa, Homo sapiens
MASANSSAGIRWSRQETRTLLSILGEAEYIQRLQTVHHNADVYQAVSKRMQQEGFRRTERQCRSKFKVLKALYLKAYVAHATSMGEPPHCPFYDTLDQLLRNQIVTDPDNLMEDAAWAKHCDQNLVASDAPGEEGTGILKSKRTQAADHQPILKTVKASDEDCQLRISDRIRETSDLEDSWDESSGAGCSQGTPSYSSSHSLFRGAVAPCQSSPMARLGVSGEPSPCTSTNRSTPGVASTPQTPVSSSRAGFVSGGDRPLTSEPPPRWARRRRRSVARTIAAELAENRRLARELSKREEEKLDRLIAIGEEASAQQDTANELRRDAVIAVRRLATAVEEATGAFQLGLEKLLQRLISNTKS

SEQ ID NO: 846968 - protein, 341 aa, Homo sapiens
MASANSSAGIRWSRQETRTLLSILGEAEYIQRLQTVHHNADVYQAVSKRMQQEGFRRTERQCRSKFKVLKALYLKAYVAHATSMGEPPHCPFYDTLDQLLRNQIVTDPDNLMEDAAWAKHCDQNLVASDAPGEEGTGILKSKRTQAADHQPILKTVKASDEDCQLRISDRIRETSDLEDSWDESSGAGCSQGTPSYSSSHSLFRGAVAPCQSSPMARLGVSGEPSPCTSTNRSTPGVASTPQTPVSSSRAGFVSGGDRPLTSEPPPRWARRRRRSVARTIAAELAENRRLARELSKREEEKLDRLIAIGEEASAQQDTANELRRDAVIAVRRLATAVEVAH

SEQ ID NO: 846969 - protein, 250 aa, Homo sapiens
MEDAAWAKHCDQNLVASDAPGEEGTGILKSKRTQAADHQPILKTVKASDEDCQLRISDRIRETSDLEDSWDESSGAGCSQGTPSYSSSHSLFRGAVAPCQSSPMARLGVSGEPSPCTSTNRSTPGVASTPQTPVSSSRAGFVSGGDRPLTSEPPPRWARRRRRSVARTIAAELAENRRLARELSKREEEKLDRLIAIGEEASAQQDTANELRRDAVIAVRRLATAVEEATGAFQLGLEKLLQRLISNTKS

SEQ ID NO: 846970 - protein, 449 aa, Homo sapiens
MAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKETAHSVLGSDANDVVITVPFDFGEKQKNALGEAARAAGFNVLRLIHEPSAALLAYGIGQDSPTGKSNILVFKLGGTSLSLSVMEVNSGIYRVLSTNTDDNIGGAHFTETLAQYLASEFQRSFKHDVRGNARAMMKLTNSAEVAKHSLSTLGSANCFLDSLYEGQDFDCNVSRARFELLCSPLFNKCIEAIRGLLDQNGFTADDINKVVLCGGSSRIPKLQQLIKDLFPAVELLNSIPPDEVIPIGAAIEAGILIGKENLLVEDSLMIECSARDILVKGLLCQLEDNTHCKPLEAYLQCALNSMSLMGRTLPKRKPSLHRLYSRI

SEQ ID NO: 846971 - protein, 374 aa, Homo sapiens
RFVTISRAVCAMRKADEVVVLVVAGPVPHTVSVTLEALCESALSMRNNGISESSASVLLASSVTMHLWSASRVEVNSGIYRVLSTNTDDNIGGAHFTETLAQYLASEFQRSFKHDVRGNARAMMKLTNSAEVAKHSLSTLGSANCFLDSLYEGQDFDCNVSRARFELLCSPLFNKCIEAIRGLLDQNGFTADDINKVVLCGGSSRIPKLQQLIKDLFPAVELLNSIPPDEVIPIGAAIEAGILIGKENLLVEDSLMIECSARDILVKGVDESGASRFTVLFPSGTPLPARRQHTLQAPGSISSVCLELYESDGKNSAKEETKFAQVVLQDLDKKENGLRDILAVLTMKRDGSLHVTCTDQETGKCEAISIEIAS

SEQ ID NO: 846972 - protein, 66 aa, Homo sapiens
SKRTQAADHQPILKTVKASDEDCQLRISDRIRETSDLEDSWDESSGAGNSQACEGVGSQSLVALNI

SEQ ID NO: 846973 - protein, 509 aa, Homo sapiens; identical to SEQ ID NO: 846966

SEQ ID NO: 846974 - protein, 250 aa, Homo sapiens; identical to SEQ ID NO: 846969

SEQ ID NO: 846975 - protein, 361 aa, Homo sapiens; identical to SEQ ID NO: 846967

SEQ ID NO: 846976 - protein, 509 aa, Homo sapiens; identical to SEQ ID NO: 846966

SEQ ID NO: 846977 - protein, 313 aa, Homo sapiens
MELDKTPLLEKVEVNSGIYRVLSTNTDDNIGGAHFTETLAQYLASEFQRSFKHDVRGNARAMMKLTNSAEVAKHSLSTLGSANCFLDSLYEGQDFDCNVSRARFELLCSPLFNKCIEAIRGLLDQNGFTADDINKVVLCGGSSRIPKLQQLIKDLFPAVELLNSIPPDEVIPIGAAIEAGILIGKENLLVEDSLMIECSARDILVKGVDESGASRFTVLFPSGTPLPARRQHTLQAPGSISSVCLELYESDGKNSAKEETKFAQVVLQDLDKKENGLRDILAVLTMKRDGSLHVTCTDQETGKCEAISIEIAS

SEQ ID NO: 846978 - protein, 302 aa, Homo sapiens [sequence omitted]

SEQ ID NO: 846979 - protein, 139 aa, Homo sapiens
MAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKGAYSPWSQSNSEDG

SEQ ID NO: 846980 - protein, 1154 aa, Homo sapiens [sequence omitted]

SEQ ID NO: 846981 - protein, 1154 aa, Homo sapiens [sequence omitted]

SEQ ID NO: 846982 - protein, 91 aa, Homo sapiens
SPASSGLRTPARAARSPLPALQPLGGRRPSEDGSGPGGTEGLVAWRKPEACVEEAPRAAGWRSMSAPDPKHCKSRCNGSLAQGTTRSSRKV

SEQ ID NO: 846983 - protein, 1268 aa, Homo sapiens
MPGGGPEMDDYMETLKDEEDALWENVECNRHMLSRYINPAKLTPYLRQCKVIDEQDEDEVLNAPMLPSKINRAGRLLDILHTKGQRGYVVFLESLEFYYPELYKLVTGKEPTRRFSTIVVEEGHEGLTHFLMNEVIKLQQQMKAKDLQRCELLARLRQLEDEKKQMTLTRVELLTFQERYYKMKEERDSYNDELVKVKDDNYNLAMRYAQLSEEKNMAVMRSRDLQLEIDQLKHRLNKMEEECKLERNQSLKLKNDIENRPKKEQVLELERENEMLKTKNQELQSIIQAGKRSLPDSDKAILDILEHDRKEALEDRQELVNRIYNLQEEARQAEELRDKYLEEKEDLELKCSTLGKDCEMYKHRMNTVMLQLEEVERERDQAFHSRDEAQTQYSQCLIEKDKYRKQIRELEEKNDEMRIEMVRREACIVNLESKLRRLSKDSNNLDQSLPRNLPVTIISQDFGDASPRTNGQEADDSSTSEESPEDSKYFLPYHPPQRRMNLKGIQLQRAKSPISLKRTSDFQAKGHEEEGTDASPSSCGSLPITNSFTKMQPPRSRSSIMSITAEPPGNDSIVRRYKEDAPHRSTVEEDNDSGGFDALDLDDDSHERYSFGPSSIHSSSSSHQSEGLDAYDLEQVNLMFRKFSLERPFRPSVTSVGHVRGPGPSVQHTTLNGDSLTSQLTLLGGNARGSFVHSVKPGSLAEKAGLREGHQLLLLEGCIRGERQSVPLDTCTKEEAHWTIQRCSGPVTLHYKVNHEGYRKLVKDMEDGLITSGDSFYIRLNLNISSQLDACTMSLKCDDVVHVRDTMYQDRHEWLCARVDPFTDHDLDMGTIPSYSRIYETITPHLRPVLEGKHHHTRFTEEETVAQRGSATLLQPHSKPVLEVGSKHRYKEPHLLPGRPLGSERTPATGPSLRRVGHAPHPCQCGAAAPLASRCLAPEFQPLRLLSSLPRAQQLLLVKLQRLMHRGSREEVDGTHHTLRALRNTLQPEEALSTSDPRVSPRLSRASFLFGQLLQFVSRSENKYKRMNSNERVRIISGSPLGSLARSSLDATKLLTEKQEELDPESELGKNLSLIPYSLVRAFYCERRRPVLFTPTVLAKTLVQRLLNSGGAMEFTICKSDIVTRDEFLRRQKTETIIYSREKNPNAFECIAPANIEAVAAKNKHCLLEAGIGCTRDLIKSNIYPIVLFIRVCEKNIKRFRKLLPRPETEEEFLRVCRLKEKELEALPCLYATVEPDMWGSVEELLRVVKDKIGEEQRKTIWVDEDQL

SEQ ID NO: 846984 - protein, 125 aa, Homo sapiens
GLSTSLLQPRSPLIAGSLPPCRLSRRRARFCIELSPCVCNIYAPVTCVCLCLKQPPRSRSSIMSITAEPPGNDSIVRRYKEDAPHRRWVAGEGGLGFCPVPPCQASLPRLWASPRLLTQLSSKQP

SEQ ID NO: 846985 - protein, 392 aa, Homo sapiens [sequence omitted]

SEQ ID NO: 846986 - protein, 381 aa, Homo sapiens
MATAAQGPLSLLWGWLWSERFWLPENVSWADLEGPADGYGYPRGRHILSVFPLAAGIFFVRLLFERFIAKPCALRIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVTCPGRIRPCTFHSFLTSFLFSMPGGSWTVSSLACIEG

SEQ ID NO: 846987 - protein, 400 aa, Homo sapiens
MATAAQGPLSLLWGWLWSERFWLPENVSWADLEGPADGYGYPRGRHILSVFPLAAGIFFVRLLFERFIAKPCALRIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLELNLSSFLQAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 846988 - protein, 392 aa, Homo sapiens [sequence omitted]

SEQ ID NO: 846989 - protein, 286 aa, Homo sapiens
MMKPRPKRFIAKPCALRIGIEDSGPYQAQPNAILEKVFISITKYPDKKRLEGLSKQLDWNVRKIQCWFRHRRNQDKPPTLTKFCESMWRFTFYLCIFCYGIRFLWSDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 846990 - protein, 233 aa, Homo sapiens
EVTLRIPSGLCIDSAGINYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 846991 - protein, 392 aa, Homo sapiens [sequence omitted]

SEQ ID NO: 846992 - protein, 393 aa, Homo sapiens
MATAAQGPLSLLWGWLWSERFWLPENVSWADLEGPADGYGYPRGRHILSVFPLAAGIFFVRLLFERFIAKPCALRIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVRMKDGFFLLGMEDRDYSTDVLSPSNLVSPIYSSRPSKKPRAPSLIRVPT

SEQ ID NO: 846993 - protein, 111 aa, Homo sapiens
MATAAQGPLSLLWGWLWSERFWLPENVSWADLEGPADGYGYPRGRHILSVFPLAAGIFFVRLLFELETGFHYVDQAGLQLLTLCSSCLSLPKCWDYRREPPRPAFLFFLKI

SEQ ID NO: 846994 - protein, 115 aa, Homo sapiens
MMKPRPKRFIAKPCALRIGIEDSGPYQAQPNAILEKVFISITKVSGQRNREEYSHKALLHGAGEDREHVPLRVRIGWDGPSYLSSPCSYMESFIPSGKTFGPYVCQVYVRSRFEF

SEQ ID NO: 846995 - protein, 426 aa, Homo sapiens
IPAAKCKQSRLWVKALVMKNKKKKIPKHFLTLVLKKTPSPKVCFSFNFLDFARLSGCKLPTLFWMDRDKFLNKDCVLSTSPSHHHHPAPRRHNYRGSFERFIAKPCALRIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 846996 - protein, 333 aa, Homo sapiens
MKPRPKRFIAKPCALRIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 846997 - protein, 195 aa, Homo sapiens [sequence omitted]

SEQ ID NO: 846998 - protein, 111 aa, Homo sapiens; identical to SEQ ID NO: 846993

SEQ ID NO: 846999 - protein, 154 aa, Homo sapiens
MMKPRPKRFIAKPCALRIGIEDSGPYQAQPNAILEKVFISITKYPDKKRLEGLSKQLDWNVRKIQCWFRHRRNQDKPPTLTKFCESMWRFTFYLCIFCYGIRFLWSPPGVWDIRKWWVINYPLQASFRWGYISYYLMDWPSMGPYVPTVPPYTH

SEQ ID NO: 847000 - protein, 405 aa, Homo sapiens [sequence omitted]

SEQ ID NO: 847001 - protein, 181 aa, Homo sapiens
MQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEKNHYEKSSGSSEGQSKTESDFSNLDSEKHKKGPMETGLFPGSNATFRILEVGCGAGNSVFPILNTLEGSPQYVLQSQFR

SEQ ID NO: 847002 - protein, 241 aa, Homo sapiens
MQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEKNHYEKSSGSSEGQSKTESDFSNLDSEKHKKGPMETGLFPGSNATFRILEVGCGAGNSVFPILNTLENSPESFLYCCDFASGAVELVKSHSSYRATQCFAFVHDVCDDGLPYPFPDGILDVILLVFVLSSIHPDRTLFI

SEQ ID NO: 847003 - protein, 405 aa, Homo sapiens [sequence omitted]

SEQ ID NO: 847004 - protein, 357 aa, Homo sapiens
MQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEKNHYEKSSGSSEGQSKTESDFSNLDSEKHKKGPMETGLFPGSNATFRILEVGCGAGNSVFPILNTLENSPESFLYCCDFASGAVELVKSHSSYRATQCFAFVHDVCDDGLPYPFPDGILDVILLVFVLSSIHPDRMQGVVNRLSKLLKPGGMLLFRDYGRYDKTQLRFKKGHCLSENFYVRGDGTRAYFFTKGEVHSMFCKASLDEKQNLVDRRLQVNRKKQVKMHRVWIQGKFQKPLHQTQNSSNMVSTLLSQD

SEQ ID NO: 847005 - protein, 496 aa, Homo sapiens
GSSAELRASASSSPAAARRSRASPRGRRRGRKAGSLVTCPLQSRNSSGGEETFPNIRGIKKSPPQLSSSSSRLSKNILSTTGKTVHQTRDDDQPRDFFKKRNRVNESHQKSSNMNAGPSWNKVQHSKNSSGKRQSKSQVPHASSQPRSSLTAVTQPTEEKLKESISPEARRKRNPLGSRCQGASGNKLFLDFQSMKIIKENADEDSASDLSDSERIPIPPSPLTPPDLNLRAEEIDPVYFDLHPGQGHTKPEYYYPNFLPSPFSSWDLRDMALLLNAENKTEAVPRVGGLLGKYIDRLIQLEWLQVQTVQCEKAKGGKARPPTAPGTSGALKSPGRSKLIASALSKPLPHQEGASKSGPSRKKAFHHEEIHPSHYAFETSPRPIDVLGGTRFCSQRQTLEMRTEEKKKKSSKSTKLQRWDLSGSGSSSKVETSGHIRVPKQAAVILDSADSCKASKTQAHAHPRKKGKAESCGHATVSSEKKLKTNGVKQNTYKLK

SEQ ID NO: 847006 - protein, 383 aa, Homo sapiens
MNAGPSWNKVQHSKNSSGKRQSKSQVPHASSQPRSSLTAVTQPTEEKLKESISPEARRKRNPLGSRCQGASGNKLFLDFQSMKIIKENADEDSASDLSDSERIPIPPSPLTPPDLNLRAEEIDPVYFDLHPGQGHTKPEYYYPNFLPSPFSSWDLRDMALLLNAENKTEAVPRVGGLLGKYIDRLIQLEWLQVQTVQCEKAKGGKARPPTAPGTSGALKSPGRSKLIASALSKPLPHQEGASKSGPSRKKAFHHEEIHPSHYAFETSPRPIDVLGGTRFCSQRQTLEMRTEEKKKKSSKSTKLQRWDLSGSGSSSKVETSGHIRVPKQAAVILDSADSCKASKTQAHAHPRKKGKAESCGHATVSSEKKLKTNGVKQNTYKLK

SEQ ID NO: 847007 - protein, 496 aa, Homo sapiens; identical to SEQ ID NO: 847005

SEQ ID NO: 847008 - protein, 496 aa, Homo sapiens; identical to SEQ ID NO: 847005

SEQ ID NO: 847009 - protein, 383 aa, Homo sapiens; identical to SEQ ID NO: 847006

SEQ ID NO: 847010 - protein, 344 aa, Homo sapiens
GSSAELRASASSSPAAARRSRASPRGRRRGRKAGSLVTCPLQSRNSSGGEETFPNIRGIKKSPPQLSSSSSRLSKNILSTTGKTVHQTRDDDQPRDFFKKRNRVNESHQKSSSWDLRDMALLLNAENKTEAVPRVGGLLGKYIDRLIQLEWLQVQTVQCEKAKGGKARPPTAPGTSGALKSPGRSKLIASALSKPLPHQEGASKSGPSRKKAFHHEEIHPSHYAFETSPRPIDVLGGTRFCSQRQTLEMRTEEKKKKSSKSTKLQRWDLSGSGSSSKVETSGHIRVPKQAAVILDSADSCKASKTQAHAHPRKKGKAESCGHATVSSEKKLKTNGVKQNTYKLK

SEQ ID NO: 847011 - protein, 300 aa, Homo sapiens
GSSAELRASASSSPAAARRSRASPRGRRRGRKAGSLVTCPLQSRNSSGGEETFPNIRGIKKSPPQLSSSSSRLSKNILSTTGKTVHQTRDDDQPRDFFKKRNRVNESHQKSSNMNAGPSWNKVQHSKNSSGKRQSKSQVPHASSQPRSSLTAVTQPTEEKLKESISPEARRKRNPLGSRCQGASGNKLFLDFQSMKIIKENADEDSASDLSDSERIPIPPSPLTPPDLNLRAEEIDPVYFDLHPGQGHTKPEYYYPNFLPSPFSSWDLRDMALLLNAENKTEAVPRVGGLLGKYIDRFLN

SEQ ID NO: 847012 - protein, 105 aa, Homo sapiens
MEFVDSLHGQPKMPEWLSTHPSHGNRVEYLDRLIPQALKIREMCNCPPLSNPDPRLLFKLSTKHFLEESEKEDLNITKKQKMDTLPIQKQEQIPLTYIVEKRTGS

SEQ ID NO: 847013 - protein, 134 aa, Homo sapiens
GGPALAKQGFVFFFPSCDPLQTSSVFWQQMEFVDSLHGQPKMPEWLSTHPSHGNRVEYLDRLIPQALKIREMCNCPPLSNPDPRLLFKLSTKHFLEESEKEDLNITKKQKMDTLPIQKQEQIPLTYIVEKRTGS

SEQ ID NO: 847014 - protein, 524 aa, Homo sapiens
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQALKIREMCNCPPLSNPDPRLLFKLSTKHFLEESEKEDLNITKKQKMDTLPIQKQEQIPLTYIVEKRTGS

SEQ ID NO: 847015 - protein, 524 aa, Homo sapiens; identical to SEQ ID NO: 847014

SEQ ID NO: 847016 - protein, 280 aa, Homo sapiens [sequence omitted]

SEQ ID NO: 847017 - protein, 524 aa, Homo sapiens; identical to SEQ ID NO: 847014

SEQ ID NO: 847018 - protein, 524 aa, Homo sapiens; identical to SEQ ID NO: 847014

SEQ ID NO: 847019 - protein, 485 aa, Homo sapiens
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQDMHVSPRAARDFERAQWNLHLSGNGILSFY

SEQ ID NO: 847020 - protein, 187 aa, Homo sapiens
MEEFKNDMLTEKDARYLAVKEVLCHLIECNKDVPGISQINWVIHVVDSPIINAFVLPNGQMFVFTGFLNSVTDIHQLSFLLGHEIAHAVLGHAYMFNRPYSRKLEAEADKIGLLLAAKALKIREMCNCPPLSNPDPRLLFKLSTKHFLEESEKEDLNITKKQKMDTLPIQKQEQIPLTYIVEKRTGS

SEQ ID NO: 847021 - protein, 524 aa, Homo sapiens; identical to SEQ ID NO: 847014

SEQ ID NO: 847022 - protein, 524 aa, Homo sapiens; identical to SEQ ID NO: 847014

SEQ ID NO: 847023 - protein, 481 aa, Homo sapiens
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAYMFNRPYSRKLEAEADKIGLLLAAKACADIRASSVFWQQMEFVDSLHGQPKMPEWLSTHPSHGNRVEYLDRLIPQALKIREMCNCPPLSNPDPRLLFKLSTKHFLEESEKEDLNITKKQKMDTLPIQKQEQIPLTYIVEKRTGS

SEQ ID NO: 847024 - protein, 524 aa, Homo sapiens; identical to SEQ ID NO: 847014

SEQ ID NO: 847025 - protein, 474 aa, Homo sapiens
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKALKIREMCNCPPLSNPDPRLLFKLSTKHFLEESEKEDLNITKKQKMDTLPIQKQEQIPLTYIVEKRTGS

SEQ ID NO: 847026 - protein, 488 aa, Homo sapiens
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQRRKLKHIRSNEQPEVTCLIRSLAKLYAIEVKGI

SEQ ID NO: 847027 - protein, 124 aa, Homo sapiens
MQFNFELSFKYVLYSSYSWLKLDHTIADCMVFTWTPCRMLDYLYSSYANMLWAGEMKSSSHQDLLFKWLDNWATKELELHLLGFELFWNTLLHFGKSKSSASGALSIENLPSFALKDVLFFIYT

SEQ ID NO: 847028 - protein, 124 aa, Homo sapiens; identical to SEQ ID NO: 847027

SEQ ID NO: 847029 - protein, 124 aa, Homo sapiens; identical to SEQ ID NO: 847027

SEQ ID NO: 847030 - protein, 638 aa, Homo sapiens
MPVLSARRRELADHAGSGRRSGPSPTARSGPHLSALRAQPARAAHLSGRGTYVRRDTAGGGPGQARPLGPPGTSLLGRGARRSGEGWCPGAFESGARAARPPSRVEPRLATAASREGAGLPRAEVAAGSGRGARSGEWGLAAAGAWETMHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 847031 - protein, 269 aa, Homo sapiens
MSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 847032 - protein, 363 aa, Homo sapiens
MPVLSARRRELADHAGSGRRSGPSPTARSGPHLSALRAQPARAAHLSGRGTYVRRDTAGGGPGQARPLGPPGTSLLGRGARRSGEGWCPGAFESGARAARPPSRVEPRLATAASREGAGLPRAEVAAGSGRGARSGEWGLAAAGAWETMHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKKQEA

SEQ ID NO: 847033 - protein, 269 aa, Homo sapiens; identical to SEQ ID NO: 847031

SEQ ID NO: 847034 - protein, 691 aa, Homo sapiens
MPVLSARRRELADHAGSGRRSGPSPTARSGPHLSALRAQPARAAHLSGRGTYVRRDTAGGGPGQARPLGPPGTSLLGRGARRSGEGWCPGAFESGARAARPPSRVEPRLATAASREGAGLPRAEVAAGSGRGARSGEWGLAAAGAWETMHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSLCLMKCWDLENPTNQPTGSSPSPPLPLTDTSICQSEPPTMRLVGWRFGGRCMQRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 847035 - protein, 343 aa, Homo sapiens [sequence omitted]

SEQ ID NO: 847036 - protein, 343 aa, Homo sapiens [sequence omitted]

SEQ ID NO: 847037 - protein, 406 aa, Homo sapiens
MKGDCDTRPEGSLPHEDLGPEAMTACPTRGGTGSAVTAIHTGVKSGAHPLERTTMDLHVLVIVGDRGRGGHTGPASMPTTATNAAPGLVAAPPRGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 847038 - protein, 638 aa, Homo sapiens; identical to SEQ ID NO: 847030

SEQ ID NO: 847039 - protein, 490 aa, Homo sapiens
MHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 847040 - protein, 490 aa, Homo sapiens; identical to SEQ ID NO: 847039

SEQ ID NO: 847041 - protein, 652 aa, Homo sapiens
MPVLSARRRELADHAGSGRRSGPSPTARSGPHLSALRAQPARAAHLSGRGTYVRRDTAGGGPGQARPLGPPGTSLLGRGARRSGEGWCPGAFESGARAARPPSRVEPRLATAASREGAGLPRAEVAAGSGRGARSGEWGLAAAGAWETMHHCKRYRSPEPDPYLSYRWKRRRSYSREHEGRLRYPSRREPPPRRSRSRSKDPADQRPHPPFGSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 847042 - protein, 269 aa, Homo sapiens; identical to SEQ ID NO: 847031

SEQ ID NO: 847043 - protein, 406 aa, Homo sapiens; identical to SEQ ID NO: 847037

SEQ ID NO: 847044 - protein, 269 aa, Homo sapiens; identical to SEQ ID NO: 847031

SEQ ID NO: 847045 - protein, 269 aa, Homo sapiens; identical to SEQ ID NO: 847031

SEQ ID NO: 847046 - protein, 395 aa, Homo sapiens
MAAEATAVAGSGAVGGCLAKDGLQQSKCPDTTPKRRRASSLSRDAERRAYQWCREYLGGAWRRVQPEELRVYPVSGGLSNLLFRCSLPDHLPSVGEEPREVLLRLYGAILQGVDSLVLESVMFAILAERSLGPQLYGVFPEGRLEQYIPSRPLKTQELREPVLSAAIATKMAQFHGMEMPFTKEPHWLFGTMERYLKQIQDLPPTGLPEMNLLEMYSLKDEMGNLRKLLESTPSPVVFCHNDIQEGNILLLSEPENADSLMLVDFEYSSYNYRGFDIGNHFCEWVYDYTHEEWPFYKARPTDYPTQEQQLHFIRHYLAEAKKGETLSQEEQRKLEEDLLVEVSRYALASHFFWGLWSILQASMSTIEFGYLDYAQSRFQFYFQQKGQLTSVHSSS

SEQ ID NO: 847047 - protein, 424 aa, Homo sapiens
MAAEATAVAGSGAVGGCLAKDGLQQSKCPDTTPKRRRASSLSRDAERRAYQWCREYLGGAWRRVQPEELRVYPVSGGLSNLLFRCSLPDHLPSVGEEPREVLLRLYGAILQGVDSLVLESVMFAILAERSLGPQLYGVFPEGRLEQYIPSRPLKTQELREPVLSAAIATKMAQFHGMEMPFTKEPHWLFGTMERYLKQIQDLPPTGLPEMNLLEMYSLKDEMGNLRKLLESTPSPVVFCHNDIQEGRRRHLSLLTQDGRARGLWSEQNLTTIPPGNILLLSEPENADSLMLVDFEYSSYNYRGFDIGNHFCEWVYDYTHEEWPFYKARPTDYPTQEQQLHFIRHYLAEAKKGETLSQEEQRKLEEDLLVEVSRYALASHFFWGLWSILQASMSTIEFGYLDYAQSRFQFYFQQKGQLTSVHSSS

SEQ ID NO: 847048 - protein, 330 aa, Homo sapiens
MAAEATAVAGSGAVGGCLAKDGLQQSKCPDTTPKRRRASSLSRDAERRAYQWCREYLGGAWRRVQPEELRVYPVSGGLSNLLFRCSLPDHLPSVGEEPREVLLRLYGAILQGVDSLVLESVMFAILAERSLGPQLYGVFPEGRLEQYIPSRPLKTQELREPVLSAAIATKMAQFHGMEMPFTKEPHWLFGTMERYLKQIQDLPPTGLPEMNLLEMYSLKDEMGNLRKLLESTPSPVVFCHNDIQEGNILLLSEPENADSLMLVDFEYSSYNYRGFDIGNHFCEWVYDYTHEEWPFYKARPTDYPTQEQQRQRKVRPSPKRSRENWKKICW

SEQ ID NO: 847049 - protein, 395 aa, Homo sapiens; identical to SEQ ID NO: 847046

SEQ ID NO: 847050 - protein, 403 aa, Homo sapiens
MAAEATAVAGSGAVGGCLAKDGLQQSKCPDTTPKRRRASSLSRDAERRAYQWCREYLGGAWRRVQPEELRVYPVSGGLSNLLFRCSLPDHLPSVGEEPREVLLRLYGAILQGVDSLVLESVMFAILAERSLGPQLYGVFPEGRLEQYIPSRPLKTQELREPVLSAAIATKMAQFHGMEMPFTKEPHWLFGTMERYLKQIQDLPPTGLPEMNLLEMYSLKDEMGNLRKLLESTPSPVVFCHNDIQEGNILLLSEPENADSLMLVDFEYSSYNYRGFDIGNHFCEWVYDYTHEEWPFYKARPTDYPTQEQQLHFIRHYLAEAKKGETLSQEEQRKLEEDLLVEVSRYALASHFFWGLWSILQASMSTIEFGYLDYAQSRFQFYSLRAQVVEVGLEQEGNFDFFFS

SEQ ID NO: 847051 - protein, 395 aa, Homo sapiens; identical to SEQ ID NO: 847046

SEQ ID NO: 847052 - protein, 395 aa, Homo sapiens; identical to SEQ ID NO: 847046

SEQ ID NO: 847053 - protein, 395 aa, Homo sapiens; identical to SEQ ID NO: 847046

SEQ ID NO: 847054 - protein, 89 aa, Homo sapiens
GTVATAGVWYLLEGEEYRMSGECQSAVSISVVSGSTSTGGISGGLGSGSGFGLSSGFGSGSGSGFGFGGSVSGSSSSKIISTTTLNKRR

SEQ ID NO: 847055 - protein, 69 aa, Homo sapiens
RPPTTTKFAAASTGGERSADILPIPGGSPGPNQEVATKLQEAESKMTRSVISRIIGVTYVPSQSNAISH

SEQ ID NO: 847056 - protein, 69 aa, Homo sapiens; identical to SEQ ID NO: 847055

SEQ ID NO: 847057 - protein, 458 aa, Homo sapiens
MSRVLNRPRVVGAAVRSFGTGGFGGGFGGSFSGKGGPGFPVCPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 847058 - protein, 338 aa, Homo sapiens
PQMSMSGARCLNRPKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 847059 - protein, 458 aa, Homo sapiens; identical to SEQ ID NO: 847057

SEQ ID NO: 847060 - protein, 458 aa, Homo sapiens; identical to SEQ ID NO: 847057

SEQ ID NO: 847061 - protein, 546 aa, Homo sapiens
PLILPSGPSAAMRSSVSRQTYSTKGGFSSNSASGGSGSQARTSFSSVTVSRSSGSGGGAHCGPGTGGFGSRSLYNLGGHKSISVSVAGGALSGRALGGFGFGSRAFMGQGAGRQTFGPACPPGGIQEVTVNQSLLTPLHVEIDPEIQRVRTQEREQIKTLNNKFASFIDKVRFLEQQNKVLETKWALLQEQGQNLGVTRNNLEPLFEAYLGSMRSTLDRLQSERGRLDSELRNVQDLVEDFKNKYEDEINKHTAAENEFVVLKKDVDAAYMGRMDLHGKVGTLTQEIDFLQQLYEMELSQVQTHVSNTNVVLSMDNNRNLDLDSIIAEVKAQYELIAQRSRAEAEAWYQTKYEELQVTAGKHGDNLRDTKNEIAELTRTIQRLQGEADAAKKQCQQLQTAIAEAEQRGELALKDAQKKLGDLDVALHQAKEDLTRLLRDYQELMNVKLALDVEIATYRKLLESEESRMSGECPSAVSISVTGNSTTVCGGGAASFGGGISLGGSGGATKGGFSTNVGYSTVKGGPVSAGTSILRKTTTVKTSSQRY

SEQ ID NO: 847062 - protein, 544 aa, Homo sapiens
PLILPSGPSAAMRSSVSRQTYSTKGGFSSNSASGGSGSQARTSFSSVTVSRSSGSGGGAHCGPGTGGFGSRSLYNLGGHKSISVSVAGGALSGRALGGFGFGSRAFMGQGAGRQTFGPACPPGGIQEVTVNQSLLTPLHVEIDPEIQRVRTQEREQIKTLNNKFASFIDKVRFLEQQNKVLETKWALLQEQGQNLGVTRNNLEPLFEAYLGSMRSTLDRLQSERGRLDSELRNVQDLVEDFKNKYEDEINKHTAAENEFVVLKKDVDAAYMGRMDLHGKVGTLTQEIDFLQQLYEMELSQVQTHVSNTNVVLSMDNNRNLDLDSIIAEVKAQYELIAQRSRAEAEAWYQTKYEELQVTAGKHGDNLRDTKNEIAELTRTIQRLQGEADAAKKQCQQLQTAIAEAEQRGELALKDAQKKLGDLDVALHQAKEDLTRLLRDYQELMNVKLALDVEIATYRKLLESEESRMSGECPSAVSICEYLLPTSCSTPGQAPELCSVYATCTCPKACSPPFEPLETGSEGPSSGLLYPFPIALLLDFVLIPH

SEQ ID NO: 847063 - protein, 307 aa, Homo sapiens
MSQCSQHLYEEEINKRTAAENDFVVLKKDVDAAYLNKVELEAKVDSLNDEINFLKVLYDAELSQVQTHVSNTNVVLSMDNNRNLDLDSIIAEVKAQYELIAQRSRAEAEAWYQTKPAAPDLVDQHGDNLKNTKSEIAELNRMIQRLRAEIENIKKQCQTLQVSVADAEQRGELALKDAQKKLGDLDVALHQAKEDLTRLLRDYQELMNVKLALDVEIATYRKLLESEESRMSGECPSAVSICEYLLPTSCSTPGQAPELCSVYATCTCPKACSPPFEPLETGSEGPSSGLLYPFPIALLLDFVLIPH

SEQ ID NO: 847064 - protein, 554 aa, Homo sapiens
ALTGLGPVTSLIAPSSLSAAMIARQQCVRGGPRGFSCGSAIVGGGKRGAFSSVSMSGGAGRCSSGGFGSRSLYNLRGNKSISMSVAGSRQGACFGGAGGWHWWLWCRRLRSWFLGTGGFGGGFGGSFSGKGGPGFPVCPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 847065 - protein, 67 aa, Homo sapiens
SGRLLLLNSRPRRRELLLDLGLVTHLEWEGCQLTSHLPWAEKKMTRSVISRIIGVTYVPSQSNAISH

SEQ ID NO: 847066 - protein, 540 aa, Homo sapiens
ALTGLGPVTSLIAPSSLSAAMIARQQCVRGGPRGFSCGSAIVGGGKRGAFSSVSMSGGAGRCSSGGFGSRSLYNLRGNKSISMSVAGSRQGACFGGAGGFGTGGFGGGFGGSFSGKGGPGFPVCPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 847067 - protein, 128 aa, Homo sapiens
AREAVLNRTRPGGAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 847068 - protein, 89 aa, Homo sapiens; identical to SEQ ID NO: 847054

SEQ ID NO: 847069 - protein, 77 aa, Homo sapiens
LIGSQDYLGSRFQQQDHLYHHPEQETIEETRSLQLTVSSWAQHWCLCASFTSPPSSVSGAHLTSIPSTIPWALSAPG

SEQ ID NO: 847070 - protein, 164 aa, Homo sapiens [sequence omitted]

SEQ ID NO: 847071 - protein, 566 aa, Homo sapiens
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 847072 - protein, 67 aa, Homo sapiens
LIKQDDDLEVPAYEDIFRDEEEDEEHSGNDSDGSEPSEKRTRLEEVSLGLSQLSQRNLHSQRSEVIL

SEQ ID NO: 847073 - protein, 248 aa, Homo sapiens
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARSGSGSEPVAAALEKSSRLFAGPMSDRTAPRSPRYMPSIRDHGPGSLFLSSFSNVDTLIYKLFIRSALK

SEQ ID NO: 847074 - protein, 189 aa, Homo sapiens
MRRDLRLIEVTETICKRLLDYSLHKERTGSNRFAKGMSETFETLHNLVHKGVKVVMDIPYELWNETSAEVADLKKQCDVLVEEFEEVIEDWYRNHQEEDLTEFLCANHVLKGKDTSCLAEQWSGKKGDTAALGGKKSKKKSSRAKAAGGRSSSSKQRKELGGLEGDPSPEEDEGIQKASPLTHSPPDEL

SEQ ID NO: 847075 - protein, 87 aa, Homo sapiens
GLVRLRVWDGKDTSCLAEQWSGKKGDTAALGGKKSKKKSSRAKAAGGRSSSSKQRKELGGLEGDPSPEEDEGIQKASPLTHSPPDEL

SEQ ID NO: 847076 - protein, 275 aa, Homo sapiens
MPEPASRCLLLLPLLLLLLLLLPAPELGPSQAGAEENDWVRLPSKCEVCKYVAVELKSAFEETGKTKEVIGTGYGILDQKASGVKYTKSDLRLIEVTETICKRLLDYSLHKERTGSNRFAKGMSETFETLHNLVHKGVKVVMDIPYELWNETSAEVADLKKQCDVLVEEFEEVIEDWYRNHQEEDLTEFLCANHVLKGKDTSCLAEQWSGKKGDTAALGGKKSKKKSSRAKAAGGRSSSSKQRKELGGLEGDPSPEEDEGIQKASPLTHSPPDEL

SEQ ID NO: 847077 - protein, 275 aa, Homo sapiens; identical to SEQ ID NO: 847076

SEQ ID NO: 847078 - protein, 275 aa, Homo sapiens; identical to SEQ ID NO: 847076

SEQ ID NO: 847079 - protein, 153 aa, Homo sapiens [sequence omitted]

SEQ ID NO: 847080 - protein, 212 aa, Homo sapiens
MPEPASRCLLLLPLLLLLLLLLPAPELGPSQAGAEENDWVRLPSKCEVCKYVAVELKSAFEETGKTKEVIGTGYGILDQKASGVKYTKSDLRLIEVTETICKRLLDYSLHKERTGSNRFAKGMSETFETLHNLVHKGVKVVMDIPYELWNETSAEVADLKKQCDVLVEEFEERSSSSKQRKELGGLEGDPSPEEDEGIQKASPLTHSPPDEL

SEQ ID NO: 847081 - protein, 153 aa, Homo sapiens [sequence omitted]

SEQ ID NO: 847082 - protein, 153 aa, Homo sapiens [sequence omitted]

SEQ ID NO: 847083 - protein, 282 aa, Homo sapiens
YIITAKSIFPSKVPFISQLSTSKTRQQQQQQQQQGKKQKTAEENDWVRLPSKCEVCKYVAVELKSAFEETGKTKEVIGTGYGILDQKASGVKYTKSDLRLIEVTETICKRLLDYSLHKERTGSNRFAKGMSETFETLHNLVHKGVKVVMDIPYELWNETSAEVADLKKQCDVLVEEFEEVIEDWYRNHQEEDLTEFLCANHVLKGKDTSCLAEQWSGKKGDTAALGGKKSKKKSSRAKAAGGRSSSSKQRKELGGLEGDPSPEEDEGIQKASPLTHSPPDEL

SEQ ID NO: 847084 - protein, 218 aa, Homo sapiens
MCRCWGTGLEGQTTNPLRLGGELSSSSSCLGRDLRLIEVTETICKRLLDYSLHKERTGSNRFAKGMSETFETLHNLVHKGVKVVMDIPYELWNETSAEVADLKKQCDVLVEEFEEVIEDWYRNHQEEDLTEFLCANHVLKGKDTSCLAEQWSGKKGDTAALGGKKSKKKSSRAKAAGGRSSSSKQRKELGGLEGDPSPEEDEGIQKASPLTHSPPDEL

SEQ ID NO: 847085 - protein, 148 aa, Homo sapiens
MPEPASRCLLLLPLLLLLLLLLPAPELGPSQAGAEENDWVRLPSKCEVCKYVAVELKSAFEETGKTKEVIGTGYGILDQKASGVKYTKSDLRLIEVTETICKRLLDYSLHKERTGSNRFAKVGFGIVLHPLWGQACMYLSVSAGVSVI

SEQ ID NO: 847086 - protein, 148 aa, Homo sapiens
MRRDLRLIEVTETICKRLLDYSLHKERTGSNRFAKCDVLVEEFEEVIEDWYRNHQEEDLTEFLCANHVLKGKDTSCLAEQWSGKKGDTAALGGKKSKKKSSRAKAAGGRSSSSKQRKELGGLEGDPSPEEDEGIQKASPLTHSPPDEL

SEQ ID NO: 847087 - protein, 107 aa, Homo sapiens
MHEGLGLFMRVLLQSQTQAEMLHSCCPRGNLKTLERGELSKIHDVQKGGGLGEVSEDTSVGVTAQSHLWVHTAPPTTPLGCPCDGPCTQYVYECFSLWRMSCLQQGP

SEQ ID NO: 847088 - protein, 87 aa, Homo sapiens; identical to SEQ ID NO: 847075

SEQ ID NO: 847089 - protein, 208 aa, Homo sapiens
MPEPASRCLLLLPLLLLLLLLLPAPELGPSQAGAEENDWVRLPSKCEVCKYVAVELKSAFEETGKTKEVIGTGYGILDQKASGVKYTKSDLRLIEVTETICKRLLDYSLHKERTGSNRFAKQEEDLTEFLCANHVLKGKDTSCLAEQWSGKKGDTAALGGKKSKKKSSRAKAAGGRSSSSKQRKELGGLEGDPSPEEDEGIQKASPLS

SEQ ID NO: 847090 - protein, 113 aa, Homo sapiens
MPEPASRCLLLLPLLLLLLLLLPAPELGPSQAGAEENDWVRLPSKCEVCKYVAVELKSAFEETGKTKEVIGTGYGILDQKASGVKYTKSISDPPDQMTYLPSSSESLPIGTCG

SEQ ID NO: 847091 - protein, 275 aa, Homo sapiens; identical to SEQ ID NO: 847076

SEQ ID NO: 847092 - protein, 135 aa, Homo sapiens
FDLKHSDIFPNDSFHILSWPAGQYGCGAEENDWVRLPSKCEVCKYVAVELKSAFEETGKTKEVIGTGYGILDQKASGVKYTKSTCRFPQSQKAQHHQRLERGPSGTAEPPEPPLLLHLILGLVMAGVQSSAPHPY

SEQ ID NO: 847093 - protein, 275 aa, Homo sapiens; identical to SEQ ID NO: 847076

SEQ ID NO: 847094 - protein, 275 aa, Homo sapiens; identical to SEQ ID NO: 847076

SEQ ID NO: 847095 - protein, 275 aa, Homo sapiens; identical to SEQ ID NO: 847076

SEQ ID NO: 847096 - protein, 329 aa, Homo sapiens
MPEPASRCLLLLPLLLLLLLLLPAPELGPSQAGAEENDWVRLPSKCEVCKYVAVELKSAFEETGKTKEVIGTGYGILDQKASGVKYTKSISDPPDQMTYLPSSSESLPIGEMCRCWGTGLEGQTTNPLRLGGELSSSSSCLGRDLRLIEVTETICKRLLDYSLHKERTGSNRFAKGMSETFETLHNLVHKGVKVVMDIPYELWNETSAEVADLKKQCDVLVEEFEEVIEDWYRNHQEEDLTEFLCANHVLKGKDTSCLAEQWSGKKGDTAALGGKKSKKKSSRAKAAGGRSSSSKQRKELGGLEGDPSPEEDEGIQKASPLTHSPPDEL

SEQ ID NO: 847097 - protein, 153 aa, Homo sapiens [sequence omitted]

SEQ ID NO: 847098 - protein, 219 aa, Homo sapiens
ELCRVSSFLEQACAGTLRRTRDLVPVPLEFTHWDLRLIEVTETICKRLLDYSLHKERTGSNRFAKGMSETFETLHNLVHKGVKVVMDIPYELWNETSAEVADLKKQCDVLVEEFEEVIEDWYRNHQEEDLTEFLCANHVLKGKDTSCLAEQWSGKKGDTAALGGKKSKKKSSRAKAAGGRSSSSKQRKELGGLEGDPSPEEDEGIQKASPLTHSPPDEL

SEQ ID NO: 847099 - protein, 113 aa, Homo sapiens; identical to SEQ ID NO: 847090

SEQ ID NO: 847100 - protein, 229 aa, Homo sapiens
MPEPASRCLLLLPLLLLLLLLLPAPELGPSQAGAEENDWVRLPSKCEGLRRDAAADERSGPVCKYVAVELKSAFEETGKTKEVIGTGYGILDQKASGVKYTKSDLRLIEVTETICKRLLDYSLHKERTGSNRFAKQEEDLTEFLCANHVLKGKDTSCLAEQWSGKKGDTAALGGKKSKKKSSRAKAAGGRSSSSKQRKELGGLEGDPSPEEDEGIQKASPLTHSPPDEL

SEQ ID NO: 847101 - protein, 168 aa, Homo sapiens
MPEPASRCLLLLPLLLLLLLLLPAPELGPSQAGAEENDWVRLPSKCEVCKYVAVELKSAFEETGKTKEVIGTGYGILDQKASGVKYTKSDLRLIEVTETICKRLLDYSLHKERTGSNRFAKGMSETFETLHNLVHKGVKVVKDTSPRKNSEPSWVAHAVLSPPQVFLS

SEQ ID NO: 847102 - protein, 123 aa, Homo sapiens
LPSSLHLCAAAGCAIQHPDSSTGRGPPLRLQGPCPSETAGMSSEKSGLPDSVPHTSPPPYNAPQPPAEPPAPPPQAAPSSHHHHHHHYHQSGTATLPRLGAGGLASSAATAQRGPSSSATLPR

SEQ ID NO: 847103 - protein, 395 aa, Homo sapiens
MPGTQTPAPAEDPHSGCRDPVPARPQACHPKSQETRFEGPLPPPPPAAAAPPPPAPAQTAQAPGFVVPTHAGTVGTLPLGGYVAPGYPLQLQPCTAYVPVYPVGTPYAGGTPGGTGVTSTLPPPPQGPGLALLEPRRPPHDYMPIAVLTTICCFWPTGIIAIFKAVQVRTALARGDMVSAEIASREARNFSFISLAVGIAAMVLCTILTVVIIIAAQQPRELLGSLKTPLVRPHSAPLDLPGSFCSHTADPMGALHTRFWGRQTWIHRKLRLHGTSRLASKLGIQFLRNPSKTHTPRDAAFRDPGQTPDPQSLQAPSPSKCSAPNRATSVWSLKPRLLYKHRPSSDKTPPPGRQAPPSFLLRGVIQSSDWVCGSRPRPQTDRPLPFFRQKDRALG

SEQ ID NO: 847104 - protein, 370 aa, Homo sapiens
MPPDPYLQETRFEGPLPPPPPAAAAPPPPAPAQTAQAPGFVVPTHAGTVGTLPLGGYVAPGYPLQLQPCTAYVPVYPVGTPYAGGTPGGTGVTSTLPPPPQGPGLALLEPRRPPHDYMPIAVLTTICCFWPTGIIAIFKAVQVRTALARGDMVSAEIASREARNFSFISLAVGIAAMVLCTILTVVIIIAAQQPRELLGSLKTPLVRPHSAPLDLPGSFCSHTADPMGALHTRFWGRQTWIHRKLRLHGTSRLASKLGIQFLRNPSKTHTPRDAAFRDPGQTPDPQSLQAPSPSKCSAPNRATSVWSLKPRLLYKHRPSSDKTPPPGRQAPPSFLLRGVIQSSDWVCGSRPRPQTDRPLPFFRQKDRALG

SEQ ID NO: 847105 - protein, 395 aa, Homo sapiens; identical to SEQ ID NO: 847103

SEQ ID NO: 847106 - protein, 336 aa, Homo sapiens
LPSSLHLCAAAGCAIQHPDSSTGRGPPLRLQGPCPSETAGMSSEKSAICRRDPGGNRSDLHSPPAAPGPRAGPTGAEAPATRLHAHRGADHHLLLLAYWHHCHLQGRAGAHGLGPRRHGVGRDRFTRGPELLLHLPGRGHRGHGALYHPHRSHHHRRAAPRELLGSLKTPLVRPHSAPLDLPGSFCSHTADPMGALHTRFWGRQTWIHRKLRLHGTSRLASKLGIQFLRNPSKTHTPRDAAFRDPGQTPDPQSLQAPSPSKCSAPNRATSVWSLKPRLLYKHRPSSDKTPPPGRQAPPSFLLRGVIQSSDWVCGSRPRPQTDRPLPFFRQKDRALG

SEQ ID NO: 847107 - protein, 264 aa, Homo sapiens
MLVTYIYSMISQSRLESRTRCSAPSDGFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVIKNPVSDHFPVGCMKVGTSFSIPVVSDVRELVPSSDPIVFVVGAFAHGKVSVEYTEKMVSISNYPLSAALTCAKLTTAFEEVWGVI

SEQ ID NO: 847108 - protein, 197 aa, Homo sapiens
MDSSLVNEAVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVIKNPVSDHFPVGCMKVGTSFSIPVVSDVRELVPSSDPIVFVVGAFAHGKVSVEYTEKMVSISNYPLSAALTCAKLTTAFEEVWGVI

SEQ ID NO: 847109 - protein, 396 aa, Homo sapiens
TQIRAHRRPRRRPPATASGPCPCPGARRAAVPPSPSSSGPCLILRPAALEVRRGCRPASTPLRLRYCTLHTRVRARKAGERKGSGSALPLKPSPLAHYGPELRAQESRIRKSRPFLEGCPPREGSARQQVISISWPTFKMAAGRKFVIRSRLFLFKSVQRNFRYCCKMAAPSDGFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVIKNPVSDHFPVGCMKVGTSFSIPVVSDVRELVPSSDPIVFVVGAFAHGKVRSGLNPEILGRAELSIEFPEQ

SEQ ID NO: 847110 - protein, 308 aa, Homo sapiens
TQIRAHRRPRRRPPATASGPCPCPGARRAAVPPSPSSSGPCLILRPAALEVRRGCRPASTPLRLRYCTLHTRVRARKAGERKGSGSALPLKPSPLAHYGPELRAQESRIRKSRPFLEGCPPREGSARQQVISISWPTFKMAAGRKFVIRSRLFLFKSVQRNFRYCCKMAAPSDGFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMGKKP

SEQ ID NO: 847111 - protein, 390 aa, Homo sapiens
TQIRAHRRPRRRPPATASGPCPCPGARRAAVPPSPSSSGPCLILRPAALEVRRGCRPASTPLRLRYCTLHTRVRARKAGERKGSGSALPLKPSPLAHYGPELRAQESRIRKSRPFLEGCPPREGSARQQVISISWPTFKMAAGRKFVIRSRLFLFKSVQRNFRYCCKMAAPSDGFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVIKNPVSDHFPVGCMKVGTSFSIPVVSDVRELVPSSDPIVFVVGAFAHGKRCDLLCCPDLSAVAQS

SEQ ID NO: 847112 - protein, 308 aa, Homo sapiens; identical to SEQ ID NO: 847110

SEQ ID NO: 847113 - protein, 361 aa, Homo sapiens
TQIRAHRRPRRRPPATASGPCPCPGARRAAVPPSPSSSGPCLILRPAALEVRRGCRPASTPLRLRYCTLHTRVRARKAGERKGSGSALPLKPSPLAHYGPELRAQESRIRKSRPFLEGCPPREGSARQQVISISWPTFKMAAGRKFVIRSRLFLFKSVQRNFRYCCKMAAPSDGFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVSVEYTEKMVSISNYPLSAALTCAKLTTAFEEVWGVI

SEQ ID NO: 847114 - protein, 411 aa, Homo sapiens
TQIRAHRRPRRRPPATASGPCPCPGARRAAVPPSPSSSGPCLILRPAALEVRRGCRPASTPLRLRYCTLHTRVRARKAGERKGSGSALPLKPSPLAHYGPELRAQESRIRKSRPFLEGCPPREGSARQQVISISWPTFKMAAGRKFVIRSRLFLFKSVQRNFRYCCKMAAPSDGFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVIKNPVSDHFPVGCMKVGTSFSIPVVSDVRELVPSSDPIVFVVGAFAHGKVSVEYTEKMVSISNYPLSAALTCAKLTTAFEEVWGVI

SEQ ID NO: 847115 - protein, 411 aa, Homo sapiens; identical to SEQ ID NO: 847114

SEQ ID NO: 847116 - protein, 185 aa, Homo sapiens
CLEDPIGRMCTSSNMEECAGPWGSAADITHQSLLMLMDSPLNRAGLLQVYIHTQKNVLIEVNPQTRIPRTFDRFCGLMVQLLHKLSVRAADGPQKLLKVIKNPVSDHFPVGCMKVGTSFSIPVVSDVRELVPSSDPIVFVVGAFAHGKVSVEYTEKMVSISNYPLSAALTCAKLTTAFEEVWGVI

SEQ ID NO: 847117 - protein, 159 aa, Homo sapiens
MLGNCLFLTFQESSLDIKHTGNSSYPWGFPCSMTGQKDCGLHLALNSFFPLLVQLLHKLSVRAADGPQKLLKVIKNPVSDHFPVGCMKVGTSFSIPVVSDVRELVPSSDPIVFVVGAFAHGKVSVEYTEKMVSISNYPLSAALTCAKLTTAFEEVWGVI

SEQ ID NO: 847118 - protein, 327 aa, Homo sapiens
TQIRAHRRPRRRPPATASGPCPCPGARRAAVPPSPSSSGPCLILRPAALEVRRGCRPASTPLRLRYCTLHTRVRARKAGERKGSGSALPLKPSPLAHYGPELRAQESRIRKSRPFLEGCPPREGSARQQVISISWPTFKMAAGRKFVIRSRLFLFKSVQRNFRYCCKMAAPSDGFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVRY

SEQ ID NO: 847119 - protein, 327 aa, Homo sapiens; identical to SEQ ID NO: 847118

SEQ ID NO: 847120 - protein, 652 aa, Homo sapiens
MFIQQIFMQRSQEHTTMAEKGRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847121 - protein, 646 aa, Homo sapiens
AQAPLDPGAARRRWRRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847122 - protein, 646 aa, Homo sapiens; identical to SEQ ID NO: 847121

SEQ ID NO: 847123 - protein, 646 aa, Homo sapiens; identical to SEQ ID NO: 847121

SEQ ID NO: 847124 - protein, 646 aa, Homo sapiens; identical to SEQ ID NO: 847121

SEQ ID NO: 847125 - protein, 646 aa, Homo sapiens; identical to SEQ ID NO: 847121

SEQ ID NO: 847126 - protein, 646 aa, Homo sapiens; identical to SEQ ID NO: 847121

SEQ ID NO: 847127 - protein, 646 aa, Homo sapiens; identical to SEQ ID NO: 847121

SEQ ID NO: 847128 - protein, 628 aa, Homo sapiens
AQAPLDPGAARRRWRRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847129 - protein, 646 aa, Homo sapiens; identical to SEQ ID NO: 847121

SEQ ID NO: 847130 - protein, 682 aa, Homo sapiens
LQAPLDPGAARRRWRRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQVPGQGGRLAVAAGSGALGGLQVLGNIPSVACLFPYQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847131 - protein, 646 aa, Homo sapiens; identical to SEQ ID NO: 847121

SEQ ID NO: 847132 - protein, 546 aa, Homo sapiens
MFIQQIFMQRSQEHTTMAEKGRDAERAECGRAKPEPERGRRRRAGSGRAEMPYKLKKEKELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847133 - protein, 711 aa, Homo sapiens
AQAPLDPGAARRRWRRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMVGTGKGQQGGLVRGSGEAQVELYTGPTPQFSVNLFRTLPPSSNPTGAEFDPEEDEPTLEAAWPHLQVPGQGGRLAVAAGSGALGGLQVLGNIPSVACLFPYQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847134 - protein, 285 aa, Homo sapiens
MVSSLKGKQNLYTPRKQIQGKETGSWLRSPKLCPPGWGREQVGVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847135 - protein, 584 aa, Homo sapiens
AQAPLDPGAARRRWRRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPKFRARPGSELRQSKRTTILN

SEQ ID NO: 847136 - protein, 110 aa, Homo sapiens
AVLYGVKVAKLGGLGVADAKRHQEGESAAAEEVGAAPGRVHHQGTGGAQAGGRVPNCQPGGSLTPHVPTTGPQPTQPWDTALALHTLLPTGCLGGRQRLSSYSREGDVGT

SEQ ID NO: 847137 - protein, 337 aa, Homo sapiens
AQAPLDPGAARRRWRRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMVGTGKDTGGTGEGLWRSPGGALTGPTPQFSVNLFRTLPPSSNPTGAEFDPEEDEPTLEAAWPHLQVPGQGGRLAVAAGSGALGGLQVLGNIPSVACLFPYSSCMSSSYVSLSLLISSQT

SEQ ID NO: 847138 - protein, 273 aa, Homo sapiens
LVLSLCRPALVVVCCSCSSSAWLRCCVLSLRRLLVAVLVLVFFLGGVSPCVCFAACCVRCLLCLLLLFSSRGLSVILLRCVVPLLVVFRLLLTSMCLLRILVCCVTNTRRGYLVCRRFYPPVWVLSSELPLNLCWFVLWGTRCCWVWCVPILIVSYLQVSLRCRQFDFASKVLLLFALALSSYRAVRARPRMPAHAQTSMRMHHPPPADSRSVSLVWHGLPLNASYSFSWDGSPPPLSALSLLVLAVAVVLVLLLCSCFCLFWLLVCSFGFFF

SEQ ID NO: 847139 - protein, 614 aa, Homo sapiens
AQAPLDPGAARRRWRRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847140 - protein, 646 aa, Homo sapiens; identical to SEQ ID NO: 847121

SEQ ID NO: 847141 - protein, 691 aa, Homo sapiens
AQAPLDPGAARRRWRRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYSEARSPGLGAKPSATEVGWEQGGGGTVQNAGGTSGVVKRAIFSSLRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847142 - protein, 646 aa, Homo sapiens; identical to SEQ ID NO: 847121

SEQ ID NO: 847143 - protein, 674 aa, Homo sapiens
AQAPLDPGAARRRWRRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMVGTGKDTGGTGEGLWRSPGGALTGPTPQFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847144 - protein, 278 aa, Homo sapiens
NSTFTEVQALCSCLPGLQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 847145 - protein, 646 aa, Homo sapiens; identical to SEQ ID NO: 847121

SEQ ID NO: 847146 - protein, 309 aa, Homo sapiens
AQAPLDPGAARRRWRRDAERAECGRAKPEPERGRRRRAGSGRAEMPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQVPGQGGRLAVAAGSGALGGLQVLGNIPSVACLFPYSSCMSSSYVSLSLLISSQT

SEQ ID NO: 847147 - protein, 69 aa, Homo sapiens
IRGRNNRIHWELVTIPHLVPIHTQMLKDIKKEKVLLRRKSELPQDVYTIKALEAHKRAEEFLTASQEAL

SEQ ID NO: 847148 - protein, 621 aa, Homo sapiens
MESSPESLQPLEHGVAAGPASGTGSSQEGLQETRLAAGDGPGVWAAETSGGNGLGAAAARRSLPDSASPAGSPEVPGPCSSSAGLDLKDSGLESPAAAEAPLRGQYKVTASPETAVAGVGHELGTAGDAGARPDLAGTCQAELTAAGSEEPSSAGGLSSSCSDPSPPGESPSLDSLESFSNLHSFPSSCEFNSEEGAENRVPEEEEGAAVLPGAVPLCKEEEGEETAQVLAASKERFPGQSVYHIKWIQWKEENTPIITQNENGPCPLLAILNVLLLAWKVKLPPMMEIITAEQLMEYLGDYMLDAKPKEISEIQRLNYEQNMSDAMAILHKLQTGLDVNVRFTGVRVFEYTPECIVFDLLDIPLYHGWLVDPQIDDIVKAVGNCSYNQLVEKIISCKQSDNSELVSEGFVAEQFLNNTATQLTYHGLCELTSTVQEGELCVFFRNNHFSTMTKYKGQLYLLVTDQGFLTEEKVVWESLHNVDGDGNFCDSEFHLRPPSDPETVYKGQQDQIDQDYLMALSLQQEQQSQEINWEQIPEGISDLELAKKLQEEEDRRASQYYQEQEQAAAAAAAASTQAQQGQPAQASPSSGRQSGNSERKRKEPREKDKEKEKEKNSCVIL

SEQ ID NO: 847149 - protein, 506 aa, Homo sapiens
MESSPESLQPLEHGVAAGPASGTGSSQEGLQETRLAAGDGPGVWAAETSGGNGLGAAAARRSLPDSASPAGSPEVPGPCSSSAGLDLKDSGLESPAAAEAPLCKEEEGEETAQVLAASKERFPGQSVYHIKWIQWKEENTPIITQNENGPCPLLAILNVLLLAWKVKLPPMMEIITAEQLMEYLGDYMLDAKPKEISEIQRLNYEQNMSDAMAILHKLQTGLDVNVRFTGVRVFEYTPECIVFDLLDIPLYHGWLVDPQIDDIVKAVGNCSYNQLVEKIISCKQSDNSELVSEGFVAEQFLNNTATQLTYHGLCELTSTVQEGELCVFFRNNHFSTMTKYKGQLYLLVTDQGFLTEEKVVWESLHNVDGDGNFCDSEFHLRPPSDPETVYKGQQDQIDQDYLMALSLQQEQQSQEINWEQIPEGISDLELAKKLQEEEDRRASQYYQEQEQAAAAAAAASTQAQQGQPAQASPSSGRQSGNSERKRKEPREKDKEKEKEKNSCVIL

SEQ ID NO: 847150 - protein, 621 aa, Homo sapiens; identical to SEQ ID NO: 847148

SEQ ID NO: 847151 - protein, 397 aa, Homo sapiens
MESSPESLQPLEHGVAAGPASGTGSSQEGLQETRLAAGDGPGVWAAETSGGNGLGAAAARRSLPDSASPAGSPEVPGPCSSSAGLDLKDSGLESPAAAEAPLRGQYKVTASPETAVAGVGHELGTAGDAGARPDLAGTCQAELTAAGSEEPSSAGGLSSSCSDPSPPGESPSLDSLESFSNLHSFPSSCEFNSEEGAENRVPEEEEGAAVLPGAVPLCKEEEGEETAQVLAASKERFPGQSVYHIKWIQWKEENTPIITQNENGPCPLLAILNVLLLAWKVKLPPMMEIITAEQLMEYLGDYMLDAKPKEISEIQRLNYEQNMSDAMAILHKLQTGLDVNVRFTGVRVFEYTPECIVFDLLDIPLYHGWLVDPQIDDIVKAVGNCTWATERDSYISK

SEQ ID NO: 847152 - protein, 123 aa, Homo sapiens
SPGQSDVDDLEADDDLLAELNEVLGEEQKASETPPPVAQPKPEAPHPGLETTLQERLALYQTAIESARQAGDSAKMRRYDRGLKTLENLLASIRTGPGLVRMCGGWEERGQEDEAASLLQGRH

SEQ ID NO: 847153 - protein, 814 aa, Homo sapiens
RGRPGEPSGRAPVRRRPRPEAEVGRPSREARARDRRPRGADEECRTQEGRVRGDRARGRRQGKAGLGGRWSGHPALKMHKRKGPPGPPGRGAAAARQLGLLVDLSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHATAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKGGLFKTDRVLGTAQLKLDALEIACEVREILEVLDGRRPTGGRLEVMVRIREPLTAQQLETTTERWLVIDPVPAAVPTQVAGPKGKAPPVPAPARESGNRSARPLHSLSVLAFDQERLERKILALRQARRPVPPEVAQQYQDIMQRSQWQRAQLEQGGVGIRREYAAQLERQLQFYTEAARRLGNDGSRDAAKEALYRRNLVESELQRLRR

SEQ ID NO: 847154 - protein, 819 aa, Homo sapiens
RGRPGEPSGRAPVRRRPRPEAEVGRPSREARARDRRPRGADEECRTQEGRVRGDRARGRRQGKAGLGGRWSGHPALKMHKRKGPPGPPGRGAAAARQLGLLVDLSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKG

SEQ ID NO: 847155 - protein, 574 aa, Homo sapiens
KVFGENCLNREAEVAVAKIVLLHSSLDDTVILCLKKEKKGSPLNDHCCHHQTLILGDWTHHRRYEISNILSLPLQQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKGGLFKTDRVLGTAQLKLDALEIACEVREILEVLDGRRPTGGRLEVMVRIREPLTAQQLETTTERWLVIDPVPAAVPTQVAGPKGKAPPVPAPARESGNRSARPLHSLSVLAFDQERLERKILALRQARRPVPPEVAQQYQDIMQRSQWQRAQLEQGGVGIRREYAAQLERQLQFYTEAARRLGNDGSRDAAKEALYRRNLVESELQRLRR

SEQ ID NO: 847156 - protein, 1028 aa, Homo sapiens
RGRPGEPSGRAPVRRRPRPEAEVGRPSREARARDRRPRGADEECRTQEGRVRGDRARGRRQGKAGLGGRWSGHPALKMHKRKGPPGPPGRGAAAARQLGLLVDLSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKGGLFKTDRVLGTAQLKLDALEIACEVREILEVLDGRRPTGGRLEVMVRIREPLTAQQLETTTERWLVIDPVPAAVPTQVAGPKGKAPPVPAPARESGNRSARPLHSLSVLAFDQERLERKILALRQARRPVPPEVAQQYQDIMQRSQWQRAQLEQGGVGIRREYAAQLERQLQFYTEAARRLGNDGSRDAAKEALYRRNLVESELQRLRR

SEQ ID NO: 847157 - protein, 236 aa, Homo sapiens
MAAGWAPGEGSSSEPTILSPLYTHAHRGLFKTDRVLGTAQLKLDALEIACEVREILEVLDGRRPTGGRLEVMVRIREPLTAQQLETTTERWLVIDPVPAAVPTQVAGPKGKAPPVPAPARESGNRSARPLHSLSVLAFDQERLERKILALRQARRPVPPEVAQQYQDIMQRSQWQRAQLEQGGVGIRREYAAQLERQLQFYTEAARRLGNDGSRDAAKEALYRRNLVESELQRLRR

SEQ ID NO: 847158 - protein, 530 aa, Homo sapiens
RGRPGEPSGRAPVRRRPRPEAEVGRPSREARARDRRPRGADEECRTQEGRVRGDRARGRRQGKAGLGGRWSGHPALKMHKRKGPPGPPGRGAAAARQLGLLVDLSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKV

SEQ ID NO: 847159 - protein, 1028 aa, Homo sapiens; identical to SEQ ID NO: 847156

SEQ ID NO: 847160 - protein, 699 aa, Homo sapiens
RGRPGEPSGRAPVRRRPRPEAEVGRPSREARARDRRPRGADEECRTQEGRVRGDRARGRRQGKAGLGGRWSGHPALKMHKRKGPPGPPGRGAAAARQLGLLVDLSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITEPPSLKSWRRTVSGAWTF

SEQ ID NO: 847161 - protein, 189 aa, Homo sapiens
KVFGENCLNREAEVAVAKIVLLHSSLDDTVILCLKKEKKGSPLNDHCCHHQTLILGDWTHHRRYEISNILSLPLQQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKCRLPFNKEGCKEADVGTDS

SEQ ID NO: 847162 - protein, 105 aa, Homo sapiens
MKAKGVWVPNSVPFPREIRAATGPTMLLRTTLRRYAKKRRRFLLVSDEVGPSRPGDYDSRRAPQSKAGRAWTRNRMWLAARVAERAGKWPRGQTRWWDSASSPLA

SEQ ID NO: 847163 - protein, 99 aa, Homo sapiens
GRYQVVSSLAEARGEMATGTDQVVGLGLVAVSLIIFTYYTAWVILLPFIDSQHVIHKYFLPRAYAVAIPLAAGLLLLLFVGLFISYVMLKSKRVTKKAQ

SEQ ID NO: 847164 - protein, 68 aa, Homo sapiens
MATGTDQVVGLGLVAVSLIIFTYYTAWVILLVCHSPRPLLTFPEPWHRQSNYYIGSRHGAGFIACLIS

SEQ ID NO: 847165 - protein, 31 aa, Homo sapiens
MQEARNTTRRKGDTDHADARMRARREQHGGR

SEQ ID NO: 847166 - protein, 105 aa, Homo sapiens; identical to SEQ ID NO: 847162

SEQ ID NO: 847167 - protein, 105 aa, Homo sapiens; identical to SEQ ID NO: 847162

SEQ ID NO: 847168 - protein, 105 aa, Homo sapiens; identical to SEQ ID NO: 847162

SEQ ID NO: 847169 - protein, 125 aa, Homo sapiens [sequence omitted]

SEQ ID NO: 847170 - protein, 105 aa, Homo sapiens; identical to SEQ ID NO: 847162

SEQ ID NO: 847171 - protein, 130 aa, Homo sapiens
MATGTDQVVGLGLVAVSLIIFTYYTAWVILLPFIDSQHVIHKYFLPRAYAVAIPLAAGLLLLLFVGKSSPPPLDPGQGFGKTPPLNMLPHFGGAGSCLPRTHPWGFPVHPSRLPVSNLWVSWCPRLFGLQ

SEQ ID NO: 847172 - protein, 252 aa, Homo sapiens
MGSELIGRLAPRLGLAEPDMLRKAEEYLRLSRVKCVGLSARTTETSSAVMCLDLAASWMKCPLDRAYLIKLSGLNKETYQSCLKSFECLLGLNSNIGIRDLAVQFSCIEAVNMASKILKSYESSLPQTQQVDLDLSRPLFTSAALLSACKILKLKVDKNKMVATSGVKKAIFDRLCKQLEKIGQQVDREPGDVATPPRKRKKIVVEAPAKEMEKVEEMPHKPQKDEDLTQDYEEWKRKILENAASAQKATAE

SEQ ID NO: 847173 - protein, 203 aa, Homo sapiens
MCLDLAASWMKCPLDRAYLIKLSGLNKETYQSCLKSFECLLGLNSNIGIRDLAVQFSCIEAVNMASKILKSYESSLPQTQQVDLDLSRPLFTSAALLSACKILKLKVDKNKMVATSGVKKAIFDRLCKQLEKIGQQVDREPGDVATPPRKRKKIVVEAPAKEMEKVEEMPHKPQKDEDLTQDYEEWKRKILENAASAQKATAE

SEQ ID NO: 847174 - protein, 252 aa, Homo sapiens; identical to SEQ ID NO: 847172

SEQ ID NO: 847175 - protein, 203 aa, Homo sapiens; identical to SEQ ID NO: 847173

SEQ ID NO: 847176 - protein, 150 aa, Homo sapiens
MGSELIGRLAPRLGLAEPDMLRKAEEYLRLSRVKCVGLSARTTETSSAVMCLDLAASWMKCPLDRAYLIKLSGLNKETYQSCLKSFECLLGLNSNIGIRDLAVQFSCIEAVNMASKILKSYESSLPQTQQVDLDLSRPLFTSAALLSACK

SEQ ID NO: 847177 - protein, 459 aa, Homo sapiens
MASSASLETMVPPACPRAGASPATSKTLAFSIERIMAKTSEPRAPFEPRPGALEADGSQGKKLLNLCSPLPCMIPLQPLGYEVPSKTLLSYSELWKSSLRAGGGGGGGGGGGGGGGGAPVCGASGLCKTNCGVCCKAELGLAPSALPAGRVIKPQVINQAVGLPASGSLYYFNYLDSTAYPPSELLSGHLFPSGLLNAQAPAALAAHPKLFLLENAKLAGLAADKFPHPAPYPHKERLPAPLEQVLKENSALTAERGGVKGHSKLPGGSADGKPKNFTCEVCGKVFNAHYNLTRHMPVHTGARPFVCKVCGKGFRQASTLCRHKIIHTQEKPHKCNQCGKAFNRSSTLNTHIRIHAGYKPFVCEFCGKGFHQKGNYKNHKLTHSGEKQYKCTICNKAFHQVYNLTFHMHTHNDKKPFTCATCGKGFCRNFDLKKHVRKLHDSVGPAAPSAKDLTRTVQS

SEQ ID NO: 847178 - protein, 109 aa, Homo sapiens
RVGNIQLLYLSGPVLVMISLLTEAVPQKQTCNRRNRSQWSLTLSPRMEYSGVISAHCKLRLLGSCHSPALASRVAGTTGACHHARLIFVFLVETGFHRISQDGLDLLTS

SEQ ID NO: 847179 - protein, 358 aa, Homo sapiens
MASSASLETMVPPACPRAGASPATSKTLAFSIERIMAKTSEPRAPFEPRPGALEADGSQGKKLLNLCSPLPCMIPLQPLGYEVPSKTLLSYSELWKSSLRAGGGGGGGGGGGGGGGGAPVCGASGLCKTNCGVCCKAELGLAPSALPAGRVIKPQVINQAVGLPASGSLYYFNYLDSTAYPPSELLSGHLFPSGLLNAQAPAALAAHPKLFLLENAKLAGLAADKFPHPAPYPHKERLPAPLEQVLKENSALTAERGGVKGHSKLPGGSADGKPKNFTCEVCGKVFNAHYNLTRHMPVHTGARPFVCKVCGKGFRQASTLCRHKIIHTQVHPPLEFEHPKNRYFCLCFADVSSATGTA

SEQ ID NO: 847180 - protein, 358 aa, Homo sapiens; identical to SEQ ID NO: 847179

SEQ ID NO: 847181 - protein, 304 aa, Homo sapiens
MASSASLETMVPPACPRAGASPATSKTLAFSIERIMAKTSEPRAPFEPRPGALEADGSQGKKLLNLCSPLPCMIPLQPLGYEVPSKTLLSYSELWKSSLRAGGGGGGGGGGGGGGGGAPVCGASGLCKTNCGVCCKAELGLAPSALPAGRVIKPQVINQAVGLPASGSLYYFNYLDSTAYPPSELLSGHLFPSGLLNAQAPAALAAHPKLFLLENAKLAGLAADKFPHPAPYPHKERLPAPLEQVLKENSALTAERGGVKGHSKLPGGSADGKPKNFTCEVCGKVFNAHYNLTRHLRQRVLQKL

SEQ ID NO: 847182 - protein, 503 aa, Homo sapiens
RVDHASEKRHAAWLGTHLLGGGGKRLRGERLRPGPAWLGSAPRAMASSASLETMVPPACPRAGASPATSKTLAFSIERIMAKTSEPRAPFEPRPGALEADGSQGKKLLNLCSPLPCMIPLQPLGYEVPSKTLLSYSELWKSSLRAGGGGGGGGGGGGGGGGAPVCGASGLCKTNCGVCCKAELGLAPSALPAGRVIKPQVINQAVGLPASGSLYYFNYLDSTAYPPSELLSGHLFPSGLLNAQAPAALAAHPKLFLLENAKLAGLAADKFPHPAPYPHKERLPAPLEQVLKENSALTAERGGVKGHSKLPGGSADGKPKNFTCEVCGKVFNAHYNLTRHMPVHTGARPFVCKVCGKGFRQASTLCRHKIIHTQEKPHKCNQCGKAFNRSSTLNTHIRIHAGYKPFVCEFCGKGFHQKGNYKNHKLTHSGEKQYKCTICNKAFHQVYNLTFHMHTHNDKKPFTCATCGKGFCRNFDLKKHVRKLHDSVGPAAPSAKDLTRTVQS

SEQ ID NO: 847183 - protein, 358 aa, Homo sapiens; identical to SEQ ID NO: 847179

SEQ ID NO: 847184 - protein, 106 aa, Homo sapiens
MPSICSCDKQKSLQTWPNVPWGAKSPPIENYCSKLWSLTLSPRMEYSGVISAHCKLRLLGSCHSPALASRVAGTTGACHHARLIFVFLVETGFHRISQDGLDLLTS

SEQ ID NO: 847185 - protein, 358 aa, Homo sapiens; identical to SEQ ID NO: 847179

SEQ ID NO: 847186 - protein, 608 aa, Homo sapiens
RKWREGVKMAPSSKSERNSGAGSGGGGPGGAGGKRAAGRRREHVLKQLERVKISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTSGSVWSSYRKSCVDMVMKWLVPESSGRYVNRMTNEALHKGCSLKVLADSERYTWIVL

SEQ ID NO: 847187 - protein, 594 aa, Homo sapiens
RKWREGVKMAPSSKSERNSGAGSGGGGPGGAGGKRAAGRRREHVLKQLERVKISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTSGSVWSSYRKSCVDMVMKWLVPESSGRYVNRMTNEALHKGGAR

SEQ ID NO: 847188 - protein, 594 aa, Homo sapiens; identical to SEQ ID NO: 847187

SEQ ID NO: 847189 - protein, 552 aa, Homo sapiens
RKWREGVKMAPSSKSERNSGAGSGGGGPGGAGGKRAAGRRREHVLKQLERVKISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTR

SEQ ID NO: 847190 - protein, 666 aa, Homo sapiens
RKWREGVKMAPSSKSERNSGAGSGGGGPGGAGGKRAAGRRREHVLKQLERVKISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTSQVLINIGLLLLAFPSPTEEGQLRPKTYHTSLKVAWDLNTGIFETVSVGDLTEVKGQTSGSVWSSYRKSCVDMVMKWLVPESSGRYVNRMTNEALHKGCSLKVLADSERYTWIVL

SEQ ID NO: 847191 - protein, 247 aa, Homo sapiens
WAWAWPLVHLPFSRLQLWTAPPASEAPASEPGYVNYTKLYYVLESGEGTEPEDELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTSGSVWSSYRKSCVDMVMKWLVPESSGRYVNRMTNEALHKGCSLKVLADSERYTWIVL

SEQ ID NO: 847192 - protein, 201 aa, Homo sapiens
PPLPASPELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTSGSVWSSYRKSCVDMVMKWLVPESSGRYVNRMTNEALHKGCSLKVLADSERYTWIVL

SEQ ID NO: 847193 - protein, 576 aa, Homo sapiens
MSLSPISLGALEGRNVDLLQISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTSGSVWSSYRKSCVDMVMKWLVPESSGRYVNRMTNEALHKGCSLKVLADSERYTWIVL

SEQ ID NO: 847194 - protein, 517 aa, Homo sapiens
RKWREGVKMAPSSKSERNSGAGSGGGGPGGAGGKRAAGRRREHVLKQLERVKISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLR

SEQ ID NO: 847195 - protein, 517 aa, Homo sapiens; identical to SEQ ID NO: 847194

SEQ ID NO: 847196 - protein, 608 aa, Homo sapiens; identical to SEQ ID NO: 847186

SEQ ID NO: 847197 - protein, 477 aa, Homo sapiens
RKWREGVKMAPSSKSERNSGAGSGGGGPGGAGGKRAAGRRREHVLKQLERVKISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDGERGAGIGSVWSSYRKSCVDMVMKWLVPESSGRYVNRMTNEALHKGCSLKVLADSERYTWIVL

SEQ ID NO: 847198 - protein, 127 aa, Homo sapiens
MSLSPISLGALEGRNVDLLQISGQLSPRLFRKLPPRVCVSLKNIVDEDFLYAGHIFLGFSKCGRYVLSYTSSSGDDDFSFYIYHLYWWEFNVHSKLKLVGRLQHQAGPSDGVVQQVTATSEPQVPWV

SEQ ID NO: 847199 - protein, 67 aa, Homo sapiens
WAGLAGGWFERRVIQRKAVTPRCGTGCKKAWWALGQTLVGTRGALGALTGGRGVQKGRMSKRECQRS

SEQ ID NO: 847200 - protein, 67 aa, Homo sapiens
LGRQPGMSLWLTFLNAQAHSFVFKYTCGWLEHRSTELSKIFSAFFREPWLVLVDVPAPSSTMNIFKN

SEQ ID NO: 847201 - protein, 1183 aa, Homo sapiens
MRMSVGLHLPLHVICDVARVCGTCYLGFHAAGSASCAQWDRTLEGRHTSLGRWPGGTKELCSAPGLLAHLPSPEALFPLPCPPTCREDDHSIIKSESWVGPRALKRLSKAGRGGYTPVIPALWEAQVRGSLSQEIKTILANMVKPRLYKNRKMSWVWWRAPVVPATQEAEAGESLETQEVEVAVSRDCATALQPGNRVRLCLKKKKKKKKDLANKHEEESESLTRPPRFGQATAKVSCPRSHGQLKLGNGRNSARLLFPCFCDEMLPSGSRSPGELLPLLVQFPAMGNSYGAMTCLTRWLRRGQKGLDDVSRAANCTSSCQLCKRICPSALGVWRGWENPGHLISNPVPRWVPSTPMPWGPGQWAAGGCVLGTSPMVWFGDPFQEPRRGTHRSRARISMSRSEEHRLWGQPDLCLRLAVVTRGSHITVGLSRPCLCRVDDAGSTCVLWWVHRGCAAGRLALTPLLQARELQSPVSCPHEPSAAGPEPQHALGTIPSPLPWIWVSVGLCRSGKATSSRSRSFSSSSSRSSSRMVSRRSVSRLLQALLLPLQALQQLLGQTEAQAWLLSELHGTQRPGAPSLPKKRHGTGLQALSWPETSLAKRKTPTLTCWALSWHCPCSRSLCSCSSTRARWASASSRLPRSSSRSWSRLSSCFSRARCLACRDYAGTDKQGGCETHRARPSHVELRRLQHLLPLGCYPPGVCVCVYGNAGHMRGRVGVGGSWQQADAHRTWSRPGSQLEEPRPLERRWLALGVSPPLPSSHTQTPLGEEFWELSFSSPRVSSVTSSHVAEAHISYHPLNGKQEELTLDCSESWLHLSLAVWPWATSLTSLNKAVSSFVKWGRQEYLPPVAVARSKHQRLRRLKPGSQQTPDYMAAVTVCKAQRTAPTWGEKGFPYPGPMSDPGDSQLNSWLLAELLRVQTQPRQPPDLPLSLGNRSPTPSTTLLRTPVRPHCPEHSYAPGPGSPSACPVLPLADGLIACHGRPAQRPPPPRSHSGFPWQMWPSLPAPLSHLAGECGYTCSSLPVGRSSRVRPHWAVSVPGSLFPQCLVQGRLSVKVSQPPHLEASQGADAQYEMIPHSLTVEPSFPAAYIADAQASEGPGLTSWWRTMLSTRAFSLSSSVLAQQTCWPAPSSRPTNSCTCASNCCTCSSSCCTCLSAAALRSPSSCSCWAFASAALSGHGMG

SEQ ID NO: 847202 - protein, 1132 aa, Homo sapiens
MLPSGSRSPGELLPLLVQFPAMGNSYGAMTCLTRWLRRGQKGLDDVSRAANCTSSCQLCKRICPSALGVWRGWENPGHLISNPVPRWVPSTPMPWGPGQWAAGGCVLGTSPMVWFGDPFQEPRRGTHRSRARISMSRSEEHRLWGQPDLCLRLAVVTRGSHITVGLSRPCLCRVDDARSTCVLWWVHRGCAAGRLALTPLLQARELQSPVSCPHEPSAAGPEPQHALGTIPSPLPWIWVSVGLCRSGKATSSRSRSFSSSSSRSSSRMVSRRSVSRLLQALLLPLQALQQLLGQTEAQAWLLSELHGTQRPGAPSLPKKRHGTGLQALSWPETSLAKRKTPTLTCWALSWHCPCSRSLCSCSSTRARWASASSRLPRSSSRSWSRLSSCFSRARCLACRDYAGTDKQGGCETHRARPSHVELRRLQHLLPLGCYPPGVCVCVYGNAGHMRGRVGVGGSWQQADAHRTWSRPGSQLEEPRPLERRWLALGVSPPLPSSHTQTPLGEEFWELSFSSPRVSSVTSSHVAEAHISYHPLNGKQEELTLDCSESWLHLSLAVWPWATSLTSLNKAVSSFVKWGRQEYLPPVAVARSKHQRLRRLKPGSQQTPDDMAAVTVCKAQRTAPTWGEKGFPYPGPMSDPGDSQLNSWLLAELLRVQTQPRQPPDLPLSLGNRSPTPSTTLLRTPVRPHCPEHSYAPGPGSPSACPVLPLADGLIACHGRPAQRPPPPRSHSGFPWQMWPSLPAPLSHLAGECGYTCSSLPVGRSSRVRPHWAVSVPGSLFPQCLVQGRLSVKVSQPPHLEASQGADAQYEMIPHSLTVEPSFPAAYIADAQASEGPGLTSWWRTMLSTRAFSLSSSVLAQQTCWPAPSSRPTNSCTCASNCCTCSSSCCTCLSAAALRSPSSCSCWAFASAALSGHGMGWAGERCTTSDLGRELTSHLWASESSATKWGSRPHLRWVWKIEGAFSVGGGNPVWSSPIVWLVRPTLLWLVPFNFALDAQGTEMDDAHPATPLAVRCGMGAYDGAPYPQPVWTPAAVSVLSPGWPSLSLGHLFLWQPRERPFRGSHGPGRRPSCPVCPVEWRQPIACRGAACGHGRSSREAGGSGWALTHPASHGLAAMCLHLSGPWCRPWRQL

SEQ ID NO: 847203 - protein, 1236 aa, Homo sapiens
MVSRRSVSRLLQALLLPLQALQQLLGQTEAQAWLLSELHGTQRPGAPSLPKKRHGTGLQALSWPETSLAKRKTPTLTCWALSWHCPCSRSLCSCSSTRARWASASSRLPRSSSRSWSRLSSCFSRARCLACRDYAGTDKQGGCETHRARPSHVELRRLQHLLPLGCYPPGVCVCVYGNAGHMRGRVGVGGSWQQADAHRTWSRPGSQLEEPRPLERRWLALGVSPPLPSSHTQTPLGEEFWELSFSSPRVSSVTSSHVAEAHISYHPLNGKQEELTLDCSESWLHLSLAVWPWATSLTSLNKAVSSFVKWGRQEYLPPVAVARSKHQRLRRLKPGSQQTPDDMAAVTVCKAQRTAPTWGEKGFPYPGPMSDPGDSQLNSWLLAELLRVQTQPRQPPDLPLSLGNRSPTPSTTLLRTPVRPHCPEHSYAPGPGSPSACPVLPLADGLIACHGRPAQRPPPPRSHSGFPWQMWPSLPAPLSHLAGECGYTCSSLPVGRSSRVRPHWAVSVPGSLFPQCLVQGRLSVKVSQPPHLEASQGADAQYEMIPHSLTVEPSFPAAYIADAQASEGPGLTSWWRTMLSTRAFSLSSSVLAQQTCWPAPSSRPTNSCTCASNCCTCSSSCCTCLSAAALRSPSSCSCWAFASAALSGHGMGWAGERCTTSDLGRELTSHLWASESSATKWGSRPHLRWVWKIEGAFSVGGGNPVWSSPIVWLVRPTLLWLVPFNFALDAQGTEMDDAHPATPLAVRCGMGAYDGAPYPQPVWTPAAVSVLSPGWPSLSLGHLFLWQPRERPFRGSHGPGRRPSCPVCPVEWRQPIACRGAACGHGRSSREAGGSGWPLPTLLLMGWLPCVYTSLGLGVVHGGNCDEAQKGQIPQASHQWALAIFWCQELCLYMAFATTREAALLGWKCQGNNSLEVALNELTVQVDTYLGSLTDRWTSLGKRPSPAPGGPSGTEITVSPPDEHPLPCCPPFPASCLCPSLGSSTQTTCPGSPVSQTSMQRLWQSPWAPGVWPLGHRPVSSCCLSCSHSDRHCSSSSACRRRAPCSCFSACSSLPACFLRPSFCPSASSSWALRASTCLLRRVRSFLCSAAQRPTVAAGSGLSPMLSCTSCWNWPKDEGRFWLCHRLMTTLPTFCRLPWTLAHASQGTRAVSMVWEWTLLVFLKVVAGNCREALTGMLSGSWQVWGKPSTGEEGLINLVVRYSGLLAGSPLVVGLEVGVSLWFAPFCVQKKTRESR

SEQ ID NO: 847204 - protein, 1132 aa, Homo sapiens
MLPSGSRSPGELLPLLVQFPAMGNSYGAMTCLTRWLRRGQKGLDDVSRAANCTSSCQLCKRICPSALGVWRGWENPGHLISNPVPRWVPSTPMPWGPGQWAAGGCVLGTSPMVWFGDPFQEPRRGTHRSRARISMSRSEEHRLWGQPDLCLRLAVVTRGSHITVGLSRPCLCRVDDAGSTCVLWWVHRGCAAGRLALTPLLQARELQSPVSCPHEPSAAGPEPQHALGTIPSPLPWIWVSVGLCRSGKATSSRSRSFSSSSSRSSSRMVSRRSVSRLLQALLLPLQALQQLLGQTEAQAWLLSELHGTQRPGAPSLPKKRHGTGLQALSWPETSLAKRKTPTLTCWALSWHCPCSRSLCSCSSTRARWASASSRLPRSSSRSWSRLSSCFSRARCLACRDYAGTDKQGGCETHRARPSHVELRRLQHLLPLGCYPPGVCVCVYGNAGHMRGRVGVGGSWQQADAHRTWSRPGSQLEEPRPLERRWLALGVSPPLPSSHTQTPLGEEFWELSFSSPRVSSVTSSHVAEAHISYHPLNGKQEELTLDCSESWLHLSLAVWPWATSLTSLNKAVSSFVKWGCQEYLPPVAVARSKHQRLRRLKPGSQQTPDDMAAVTVCKAQRTAPTWGEKGFPYPGPMSDPGDSQLNSWLLAELLRVQTQPRQPPDLPLSLGNRSPTPSTTLLRTPVRPHCPEHSYAPGPGSPSACPVLPLADGLIACHGRPAQRPPPPRSHSGFPWQMWPSLPAPLSHLAGECGYTCSSLPVGRSSRVRPHWAVSVPGSLFPQCLVQGRLSVKVSQPPHLEASQGADAQYEMIPHSLTVEPSFPAAYIADAQASEGPGLTSWWRTMLSTRAFSLSSSVLAQQTCWPAPSSRPTNSCTCASNCCTCSSSCCTCLSAAALRSPSSCSCWAFASAALSGHGMGWAGERCTTSDLGRELTSHLWASESSATKWGSRPHLRWVWKIEGAFSVGGGNPVWSSPIVWLVRPTLLWLVPFNFALDAQGTEMDDAHPATPLAVRCGMGAYDGAPYPQPVWTPAAVSVLSPGWPSLSLGHLFLWQPRERPFRGSHGPGRRPSCPVCPVEWRQPIACRGAACGHGRSSREAGGSGWALTHPASHGLAAMCLHLSGPWCRPWRQL

SEQ ID NO: 847205 - protein, 90 aa, Homo sapiens
QVDLFKRRVVRRLASLKTRRCRLNRAAQGLPDPGAETCAVCLDYFCNKQWLRVLPCKHEFHRDCVDPWLMLQQTCPLCKFNVLGNRYSDD

SEQ ID NO: 847206 - protein, 348 aa, Homo sapiens
MRKMSEEEFYLFKNISSVGPWDGPQYHIAPVWAFYLQAAFMGTVFLIGFPLNAMVLVATLRYKKLRQPLNYILVNVSFGGFLLCIFSVFPVFVASCNGYFVFGRHVCALEGFLGTVAGLVTGWSLAFLAFERYIVICKPFGNFRFSSKHALTVVLATWTIGIGVSIPPFFGWSWFIPEGLQCSCGPDWYTVGTKYRSESYTWFLFIFCFIVPLSLICFSYTQLLRALKAVAAQQQESATTQKAEREVSRMVVVMVGSFCVCYVPYAAFAMYMVNNRNHGLDLRLVTIPSFFSKSACIYNPIIYCFMNKQFQACIMKMVCGKAMTDESDTCSSQKTEVSTVSSTQVGPN

SEQ ID NO: 847207 - protein, 526 aa, Homo sapiens
MNALGLGQYKNSEKSVCRRHRNQCHSVTEATIIVKNTSAVMDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 847208 - protein, 526 aa, Homo sapiens; identical to SEQ ID NO: 847207

SEQ ID NO: 847209 - protein, 526 aa, Homo sapiens; identical to SEQ ID NO: 847207

SEQ ID NO: 847210 - protein, 451 aa, Homo sapiens
MNALGLGQYKNSEKSVCRRHRNQCHSVTEATIIVKNTSAVMDSSVIQRKKVAVIGGGLIVSQGIPMRARMIHSLSGKKSAIPYGTKSQYILSVSRENLNKDLLTAAEKYPNVKMQSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 847211 - protein, 526 aa, Homo sapiens; identical to SEQ ID NO: 847207

SEQ ID NO: 847212 - protein, 526 aa, Homo sapiens; identical to SEQ ID NO: 847207

SEQ ID NO: 847213 - protein, 271 aa, Homo sapiens [sequence omitted]

SEQ ID NO: 847214 - protein, 513 aa, Homo sapiens
MNALGLGQYKNSEKSVCRRHRNQCHSVTEATIIVKNTSAVMDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 847215 - protein, 267 aa, Homo sapiens
MNALGLGQYKNSEKSVCRRHRNQCHSVTEATIIVKNTSAVMDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFITTAQP

SEQ ID NO: 847216 - protein, 513 aa, Homo sapiens; identical to SEQ ID NO: 847214

SEQ ID NO: 847217 - protein, 470 aa, Homo sapiens
MNALGLGQYKNSEKSVCRRHRNQCHSVTEATIIVKNTSAVMDSSVIQRKKVAVIGGGLIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 847218 - protein, 507 aa, Homo sapiens
MNALGLGQYKNSEKSVCRRHRNQCHSVTEATIIVKNTSAVMDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMQSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 847219 - protein, 405 aa, Homo sapiens
MRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 847220 - protein, 526 aa, Homo sapiens; identical to SEQ ID NO: 847207

SEQ ID NO: 847221 - protein, 165 aa, Homo sapiens
MNALGLGQYKNSEKSVCRRHRNQCHSVTEATIIVKNTSAVMDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTGKSNV

SEQ ID NO: 847222 - protein, 722 aa, Homo sapiens
ATMAQGLEVALTDLQSSRNNVRHHTEEITVDHLLVRRGQAFNLTLYFRNRSFQPGLDNIIFVVETGPLPDLALGTRAVFSLARHHSPSPWIAWLETNGATSTEVSLCAPPTAAVGRYLLKIHIDSFQGSVTAYQLGEFILLFNPWCPEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 847223 - protein, 640 aa, Homo sapiens
ATMAQGLEVALTDLQSSRNNVRHHTEEITVDHLLVRRGQAFNLTLYFRNRSFQPGLDNIIFVVETEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 847224 - protein, 377 aa, Homo sapiens
MARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 847225 - protein, 453 aa, Homo sapiens
MGSVLGLCSMASWIPCLCGSAPCLLCRCCPSGNNSTVTRLIYALFLLVGVCVACVMLIPGMEEQLNKIPGFCENEKGVVPCNILVGYKAVYRLCFGLAMFYLLLSLLMIKVKSSSDPRAAVHNGFWFFKFAAAIAIIIGAFFIPEGTFTTVWFYVGMAGAFCFILIQLVLLIDFAHSWNESWVEKMEEGNSRCWYAALLSATALNYLLSLVAIVLFFVYYTHPASCSENKAFISVNMLLCVGASVMSILPKIQESQPRSGLLQSSVITVYTMYLTWSAMTNEPETNCNPSLLSIIGYNTTSTVPKEGQSVQWWHAQGIIGLILFLLCVFYSSIRTSNNSQVNKLTLTSDESTLIEDGGARSDGSLEDGDDVHRAVDNERDGVTYSYSFFHFMLFLASLYIMMTLTNWYRYEPSREMKSQWTAVWVKISSSWIGIVLYVWTLVAPLVLTNRDFD

SEQ ID NO: 847226 - protein, 453 aa, Homo sapiens; identical to SEQ ID NO: 847225

SEQ ID NO: 847227 - protein, 453 aa, Homo sapiens; identical to SEQ ID NO: 847225

SEQ ID NO: 847228 - protein, 453 aa, Homo sapiens; identical to SEQ ID NO: 847225

SEQ ID NO: 847229 - protein, 430 aa, Homo sapiens
MGSVLGLCSMASWIPCLCGSAPCLLCRCCPSGNNSTVTRLIYALFLLVGVCVACVMLIPGMEEQLNKIPGFCENEKGVVPCNILVGYKAVYRLCFGLAMFYLLLSLLMIKVKSSSDPRAAVHNGFWFFKFAAAIAIIIGAFFIPEGTFTTVWFYVGMAGAFCFILIQLVLLIDFAHSWNESWVEKMEEGNSRCWYAALLSATALNYLLSLVAIVLFFVYYTHPASCSENKAFISVNMLLCVGASVMSILPKIQESQPRSGLLQSSVITVYTMYLTWSAMTNEPETNCNPSLLSIIGYNTTSTVPKEGQSVQWWHAQGIIGLILFLLCVFYSSIRTSNNSQVNKLTLTSDESTLIEDGGARSDGSLEDGDDVHRAVDNERDGVTYSYSFFHFMLFLASLYIMMTLTNWYRYEPSREMKSQWTAVLVETTPL

SEQ ID NO: 847230 - protein, 64 aa, Homo sapiens
IEDGGARSDGSLEDGDDVHRAVDNERDGVTYSYSFFHFMLFLASLYIMMTLTNWYRVFIFHENS

SEQ ID NO: 847231 - protein, 453 aa, Homo sapiens; identical to SEQ ID NO: 847225

SEQ ID NO: 847232 - protein, 453 aa, Homo sapiens; identical to SEQ ID NO: 847225

SEQ ID NO: 847233 - protein, 74 aa, Homo sapiens
PISGHFIAEHYMFLKGHETYIMMTLTNWYRYEPSREMKSQWTAVWVKISSSWIGIVLYVWTLVAPLVLTNRDFD

SEQ ID NO: 847234 - protein, 453 aa, Homo sapiens; identical to SEQ ID NO: 847225

SEQ ID NO: 847235 - protein, 413 aa, Homo sapiens
MGSVLGLCSMASWIPCLCGSAPCLLCRCCPSGNNSTVTRLIYALFLLVGVCVACVMLIPGMEEQLNKIPGFCENEKGVVPCNILVGYKAVYRLCFGLAMFYLLLSLLMIKVKSSSDPRAAVHNGFWFFKFAAAIAIIIGAFFIPEGTFTTVWFYVGMAGAFCFILIQLVLLIDFAHSWNESWVEKMEEGNSRCWYAALLSATALNYLLSLVAIVLFFVYYTHPASCSENKAFISVNMLLCVGASVMSILPKIQESQPRSGLLQSSVITVYTMYLTWSAMTNEPETNCNPSLLSIIGYNTTSTVPKEGQSVQWWHAQGIIGLILFLLCVFYSSIRTSNNSQVNKLTLTSDESTLIEDGGARSDGSLEDGDDVHRAVDNERDGVTYSYSFFHFMLFLASLYIMMTLTNWYRGQNF

SEQ ID NO: 847236 - protein, 119 aa, Homo sapiens
MHLINSLTLRPWGLRALADHGCPGARRPPPLGSLPRFRWTPTGNTPGPSSRPLLAPIPPPPARSVPLLQPRHQLGREELAPTQTYWFDEGRAHGSATGPGHPVLVSRGSPPGLSGGWVL

SEQ ID NO: 847237 - protein, 134 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGRFKDWMVSMIVDREYSVAVEAVRLLILILKNMEGVLMDVDCESVYPIV

SEQ ID NO: 847238 - protein, 117 aa, Homo sapiens
RFFSERPQQGQKGGGRPPSWSGVYSEPWCLAVSERWCLAVSERWCLAVSDRWCLAVSDRWCLARATLSCFGCAMPMYQVKPYHRVCAPLRVEPTCMYWLPNMHGRSGGPALGTGHLQ

SEQ ID NO: 847239 - protein, 134 aa, Homo sapiens; identical to SEQ ID NO: 847237

SEQ ID NO: 847240 - protein, 116 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGRFKDWMVSMIVDREYSVAVEAVRLLILILK

SEQ ID NO: 847241 - protein, 119 aa, Homo sapiens; identical to SEQ ID NO: 847236

SEQ ID NO: 847242 - protein, 179 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGRFKDWMVSMIVDREYSVAVEAVRLLILILKLFYPECEIRTMGGREQRQSPGAQRTFFQLLLSFFVESKVTYTEITLAVVHRTYKWAGVGGSRL

SEQ ID NO: 847243 - protein, 134 aa, Homo sapiens; identical to SEQ ID NO: 847237

SEQ ID NO: 847244 - protein, 119 aa, Homo sapiens; identical to SEQ ID NO: 847236

SEQ ID NO: 847245 - protein, 246 aa, Homo sapiens
MAWQVSLLELEDRLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWVSGQ

SEQ ID NO: 847246 - protein, 174 aa, Homo sapiens
MAWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVSEFQELRHPVDEEKARCLEGIGGHTRGLVASLDMQLEQAQGTRERLAQAECVLEQFGNEDHHEFIWVSGQ

SEQ ID NO: 847247 - protein, 134 aa, Homo sapiens; identical to SEQ ID NO: 847237

SEQ ID NO: 847248 - protein, 134 aa, Homo sapiens; identical to SEQ ID NO: 847237

SEQ ID NO: 847249 - protein, 205 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGRFKDWMVSMIVDREYSVAVEAVRLLILILKLFYPECEIRTMGGREQRQSPGAQRTFFQLLLSFFVESKLHDHAAYLVDNLWDCAGTQLKDWEGLTSLLLEKDQSTCHMEPGPGTFHLLG

SEQ ID NO: 847250 - protein, 50 aa, Homo sapiens
MGGREQRQSPGAQRTFFQLLLSFFVESKLHNHAANLVENPGVGGGAALES

SEQ ID NO: 847251 - protein, 117 aa, Homo sapiens; identical to SEQ ID NO: 847238

SEQ ID NO: 847252 - protein, 134 aa, Homo sapiens; identical to SEQ ID NO: 847237

SEQ ID NO: 847253 - protein, 117 aa, Homo sapiens
VFFPNARSRVRREVVALRRGLACIPSLGVWRFPSVGVWRFPSVGVWRFPTVGVWRFPTVGVWHAPPSLALVAPCRCTRLRLKKKKKGWRPAWVTDQDPDSGIKTKNRMWLVFCNQDV

SEQ ID NO: 847254 - protein, 117 aa, Homo sapiens; identical to SEQ ID NO: 847238

SEQ ID NO: 847255 - protein, 85 aa, Homo sapiens
VFFPNARSRVRREVVALRRGLACIPSLGVWRFPSVGVWRFPSVGVWRFPTVGVWRFPTVGVWHAPPSLALVAPCRCTRQEDKKMI

SEQ ID NO: 847256 - protein, 134 aa, Homo sapiens; identical to SEQ ID NO: 847237

SEQ ID NO: 847257 - protein, 134 aa, Homo sapiens; identical to SEQ ID NO: 847237

SEQ ID NO: 847258 - protein, 116 aa, Homo sapiens; identical to SEQ ID NO: 847240

SEQ ID NO: 847259 - protein, 119 aa, Homo sapiens; identical to SEQ ID NO: 847236

SEQ ID NO: 847260 - protein, 134 aa, Homo sapiens; identical to SEQ ID NO: 847237

SEQ ID NO: 847261 - protein, 134 aa, Homo sapiens; identical to SEQ ID NO: 847237

SEQ ID NO: 847262 - protein, 115 aa, Homo sapiens
MKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWVSGQ

SEQ ID NO: 847263 - protein, 183 aa, Homo sapiens [sequence omitted]

SEQ ID NO: 847264 - protein, 134 aa, Homo sapiens; identical to SEQ ID NO: 847237

SEQ ID NO: 847265 - protein, 134 aa, Homo sapiens; identical to SEQ ID NO: 847237

SEQ ID NO: 847266 - protein, 134 aa, Homo sapiens; identical to SEQ ID NO: 847237

SEQ ID NO: 847267 - protein, 205 aa, Homo sapiens; identical to SEQ ID NO: 847249

SEQ ID NO: 847268 - protein, 147 aa, Homo sapiens
YPYHTVLRRNRRAETGVSLSRRSTQRLEELKLVYPYHGVVRRNRRAEDHRCNDGPQLNPHAPPSPAPRPRCLLSRQPVGLCRDSAEGLGGSDKPAAGEGPEHVPHGARARDLPPPRVKPGEIACFTCTRQERWHGVGETWSWKVANL

SEQ ID NO: 847269 - protein, 151 aa, Homo sapiens
MGAGATLPTATARAPHAWGELPARRQAMQPPLRLRSQDQPGQEGPGDTEASQTEPGSSAVTLQEQPSLSQNESDVFSWVIRREFQELRHPVDEEKARCLEGIGGHTRGLVASLDMQLEQAQGTRERLAQAECVLEQFGNEDHHEFIWVSGQ

SEQ ID NO: 847270 - protein, 662 aa, Homo sapiens
MGCEGPGLKRWRTRPPGAHGSCSGGDQTGVGVGGGMEGLAGYVYKAASEGKVLTLAALLLNRSESDIRYLLGYVSQQGGQRSTPLIIAARNGHAKVVRLLLEHYRVQTQQTGTVRFDGYVIDGATALWCAAGAGHFEVVKLLVSHGANVNHTTVTNSTPLRAACFDGRLDIVKYLVENNANISIANKYDNTCLMIAAYKGHTDVVRYLLEQRADPNAKAHCGATALHFAAEAGHIDIVKELIKWRAAIVVNGHGMTPLKVAAESCKADVVELLLSHADCDRRSRIEALELLGASFANDRENYDIIKTYHYLYLAMLERFQDGDNILEKEVLPPIHAYGNRTECRNPQELESIRQDRDALHMEGLIVRERILGADNIDVSHPIIYRGAVYADNMEFEQCIKLWLHALHLRQKGNRNTHKDLLRFAQVFSQMIHLNETVKAPDIECVLRCSVLEIEQSMNRVKNISDADVHNAMDNYECNLYTFLYLVCISTKTQCSEEDQCKINKQIYNLIHLDPRTREGFTLLHLAVNSNTPVDDFHTNDVCSFPNALVTKLLLDCGAEVNAVDNEGNSALHIIVQYNRPISDFLTLHSIIISLVEAGAHTDMTNKQNKTPLDKSTTGVSEILLKTQMKMSLKCLAARAVRANDINYQDQIPRTLEEFVGFH

SEQ ID NO: 847271 - protein, 662 aa, Homo sapiens; identical to SEQ ID NO: 847270

SEQ ID NO: 847272 - protein, 662 aa, Homo sapiens; identical to SEQ ID NO: 847270

SEQ ID NO: 847273 - protein, 588 aa, Homo sapiens
MGCEGPGLKRWRTRPPGAHGSCSGGDQTGVGVGGGMEGLAGYVYKAASEGKVLTLAALLLNRSESDIRYLLGYVSQQGGQRSTPLIIAARNGHAKVVRLLLEHYRVQTQQTGTVRFDGYVIDGATALWCAAGAGHFEVVKLLVSHGANVNHTTVTNSTPLRAACFDGRLDIVKYLVENNANISIANKYDNTCLMIAAYKGHTDVVRYLLEQRADPNAKAHCGATALHFAAEAGHIDIVKELIKWRAAIVVNGHGMTPLKVAAESCKADVVELLLSHADCDRRSRIEALELLGASFANDRENYDIIKTYHYLYLAMLERFQDGDNILEKEVLPPIHAYGNRTECRNPQELESIRQDRDALHMEGLIVRERILGADNIDVSHPIIYRGAVYADNMEFEQCIKLWLHALHLRQKVCISTKTQCSEEDQCKINKQIYNLIHLDPRTREGFTLLHLAVNSNTPVDDFHTNDVCSFPNALVTKLLLDCGAEVNAVDNEGNSALHIIVQYNRPISDFLTLHSIIISLVEAGAHTDMTNKQNKTPLDKSTTGVSEILLKTQMKMSLKCLAARAVRANDINYQDQIPRTLEEFVGFH

SEQ ID NO: 847274 - protein, 662 aa, Homo sapiens; identical to SEQ ID NO: 847270

SEQ ID NO: 847275 - protein, 662 aa, Homo sapiens; identical to SEQ ID NO: 847270

SEQ ID NO: 847276 - protein, 662 aa, Homo sapiens; identical to SEQ ID NO: 847270

SEQ ID NO: 847277 - protein, 588 aa, Homo sapiens; identical to SEQ ID NO: 847273

SEQ ID NO: 847278 - protein, 176 aa, Homo sapiens
APSYVCASVSVASAVRPLCPSISSVQQFVLLFSSPLAVGCVFSAVGRGVVSLYLLCCFVSALASRSVSLCVLLRLLRGILALLVSFVPGCIWSCWPCVLLCLAVVSADGVCCAARVSVAVVGVVTVLGHAVPERAFVVMVVFVLLPDVVSSWFVVSGVSLRSVFVCSLRFTCAVEL

SEQ ID NO: 847279 - protein, 518 aa, Homo sapiens
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 847280 - protein, 518 aa, Homo sapiens; identical to SEQ ID NO: 847279

SEQ ID NO: 847281 - protein, 318 aa, Homo sapiens [sequence omitted]

SEQ ID NO: 847282 - protein, 244 aa, Homo sapiens
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGWCTSWALQCGAGRGCHRPVSVSASRCGQSLLHWKCAHWHEDHGDVS

SEQ ID NO: 847283 - protein, 415 aa, Homo sapiens
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLSMSSFCLLLDDLN

SEQ ID NO: 847284 - protein, 286 aa, Homo sapiens
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGVVNRPKDEIGIPSGDTGWSLITATLDILVF

SEQ ID NO: 847285 - protein, 211 aa, Homo sapiens
MFLRAGLAALSPLLRSLRPSPVAAMSTGTFVVSQPLNYRGGARVEPADASGTEKAFEPATGRVIATFTCSGEKEVNLAVQNAKAAFKIWSQEREDEIATMECINNGKSIFEARLDIDISWQCLEYYAGLAASMAGEHIQLPGGSFGYTRREPLGVCVGIGAWNYPFQIASWKSAPALACVHGFLLHCSDALLNYRSCVLWVSCVRRGCTAV

SEQ ID NO: 847286 - protein, 424 aa, Homo sapiens
MERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 847287 - protein, 331 aa, Homo sapiens
VGRSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 847288 - protein, 342 aa, Homo sapiens
SRVGQEKLGQAALSSRGLEDSLRLWRQGHYTHFRMKSCGSMLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 847289 - protein, 158 aa, Homo sapiens
EVGRIKAGKSDFRVAGGNEAWRGLLSIPRICLLLFPLPTGLNGSLRLFPPQHLGRNGIFHCPSCPGSVLRGTLARLPEKAPDVTDLRDPKQPALPPPIRHSPAFSFLTLPPATVGSRLGISKQRVERGLRTQARWESALFKGPGLLLTGIKELRVVHG

SEQ ID NO: 847290 - protein, 246 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSYLRNSYDAN

SEQ ID NO: 847291 - protein, 113 aa, Homo sapiens
HRLAVQRMRWERLSRPGPGEPGVHFPQEATECPPLSLQMTASHPHPLAWTQSGSLLQADTGGPAPLQRVLQPTSVQALPDLVRWEAHLQHLQVRDGEMGPQEPQLGPVLRVLS

SEQ ID NO: 847292 - protein, 341 aa, Homo sapiens
HGPGVGARGGGLIAGRLFRGRRVLPSPSHALITPFSGGSMLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 847293 - protein, 564 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQKRIMGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGACSCEDNSLGLGVNHR

SEQ ID NO: 847294 - protein, 206 aa, Homo sapiens
SRGGVNRTRAFICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 847295 - protein, 146 aa, Homo sapiens [sequence omitted]

SEQ ID NO: 847296 - protein, 174 aa, Homo sapiens
SRGSPAAPSSQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 847297 - protein, 535 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQKRIMGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVDVDECRTSITLCSHHCFNTAGSFTCGCPHDLVLGVDGRTCMEGSPEPPTSASILSVAVREAEKDERALKQEIHELRGRLERLEQVSQACWVGRGQTSLSIP

SEQ ID NO: 847298 - protein, 237 aa, Homo sapiens [sequence omitted]
